United States Patent 12,433,215 (METHODS OF ENHANCING GRAIN YIELD, PLANTS AND PRODUCTS GENERATED THEREBY) - sequence listing, part 2

SEQ ID NO: 30 - DNA, 35937250 bp, Oryza sativa (residues 2,113,957-4,227,912 of 35,937,250)
  misc_feature (5969519)..(5970518): n is a, c, g, or t
  misc_feature (13681864)..(13682863): n is a, c, g, or t
  misc_feature (13684155)..(13684254): n is a, c, g, or t
  misc_feature (18795366)..(18796365): n is a, c, g, or t
  misc_feature (24815509)..(24816508): n is a, c, g, or t
  misc_feature (35936251)..(35937250): n is a, c, g, or t
tggtagccagtatagcttgaactgtgaaagctgtgtcccagagctggctgccattgtaaccctacagtaagccaaaccacaatttattgacattgacgctagtaagctgcatgcatgcacaaacacagtacaatattcatgcataatactccctccgtcccactaactaaggcgtgcacgtattttaagattaaactctttaaatatttgatcattaaatagtttattataaattaaattttatttgatgaaaacaatatcattggattatcatttaaatttaccttcatatgattatgattttgttgctacaaacattatagtatatgaaaaatttaaagtcaaagattaattttgaagaccgtgcaaagtttgatcgtgccttggtgagtgggacagaggtatagttgaccaaaacgcccgagacccgacaacctggcccatggcacagggttttggcctggtccaagcacgacacggcttgactggtgttgggctcgtgcctaggcctctgcctcagcacgataagccggcccagcacggcctggtccaacaatcaagaaggcaaaatagatgagggagccaaaatagccttattccaggcatataaggcacgtcccaaagagatgagggaggaaaaatagactttttccagggaggaaaatagactttttccaaggaggggcacaatgggctttcgtgccttcgggctggtccggcacggcccaagtcttattgggccatgcttggaccgttggtgcagcaagtgggcgtgctcagcctagcccaacatgtaggttgggccatgctggcctgactgatctcgggcccaggcccggtccgggcggcctatttggccatctatagtcgagggagtatcttccaatactagtaggcatccattgtgacaacttccacttaaacatcgagccatacaccacacagattttgtgcatagagtcagttaaaaagaatgatgcaaatacgtaagtatcaactgaaaatgctaaaataattttgcaatgtgattaagataagcaaatatgtggataagcttactgttgacacaaccacctcaactgaaagcaaataaaatggattcaaaagatagccattagtcccaaatatgaaataagcacttgcatcttcatgccatcttcagcgacccacaagtaatcatgaacccttggaatatgaaatctgaatgcctctgagttaggattttctatccagcaagaaagcatatttaatacctgcatttaaaaaaaatcacaacaatcagtaataaaggcatcaaagtaaacagaagaacaagaagagctcttttttttagagagttgtcattgtcttcaatttaccttctgtacagcaccgctgcaaatgtatcgagtattctcatcttcgtaatgaatatgctgcatggcattcttcagagctttctctctcaatttgctgccaggccaatgcgatagaactggttcaacaaatttgtaaagagtggcccataggatatcttgccctaatggatgacggtagtacagatcctcctgcaatacataattcttttttctttattaaataagaaacttatcctacacagacatgtctacctgaagtaacaagaactgagtagcaacagacactatggtattgcaagataaagttgttttttatgtccttgctgtttgacccgtgcacaatcagaaagacaaagaaagtataaagctcataaaccttagcgcattggttacgagccttgtcccaattaatatcatcatagggtatattgtagagctcctttcgtagggtcagtactattggtgtaattgggccgacaaacttctttccgtaaatataagacataggcaagtataccattcggcagtgggaccatatccgtcctggacataggcaaacaaaatatactgattgtaagataaaattttctacagattacagaacactaaaaagaatgttgtaaaggcaccctaagaacatggtcgctgatctatctcaaacaaattggctggaggagcaatgcatgaatctagtaatatagggattgatacacttaaaaaattattagagattaagcatgctgcatgcgtttggttcaagggatggaatgggtcggattggattgaactcacttttcaaggtatttggtttggagatagatgggatgggatgaacctgaaagggaatattcttctaagatccgggttggcatggtcccttgaaaattggcagaccaatccaacccacttctttgtctcgctgacatgtgagccatccccttaaaactgggaccatttcatccctcatgccaaacagatagatagggccatcccatccaaaaacacaaggatgagtccaacccatcccaactcattcctaaaccaaatatatgcttatgatgttcagaataggcacgtaccttgaagaatttaaccaatctatacatattcctgaaccttcttccttttgttttatgaaaattccatgtcagcatattcataaattttctatcatatcattagagtaaaaatattctgtatttatgtttctgcaattatataaatccattctttccaaatggggctaatttcccctgtttcttttataaagggagacatagcctattgtactaacactttatcaacccacaacatggattctagtgcaatatacgtacgtggcagcaacccggtacacacttattcaaagtaagctgccaaagaaccatgtttgtatatagtgaatacctgcactagcatgcactccagccagtacctacgataattttctctattattgtatgatgaacttacactctaccaaattaagattaaagagtaaaaagaaataaaacgtaaggagaaggcaaacctggatgaaatgggaggaaataaggtagcatccacaattctggaagcaatgggttgttaccagaccagtcaaagacaccaagtaccttaagaaagttaattaagacattagcaggacctctctaggattgtaaaacaaggtagaattgtatagggaccagagcaaaaacacaaaaggaaattaaaatgcgtaggttccctactgaaagccaaaattttccccatgatgttgtgaaagttgctcctccatgatctaaaatccaatttcgagctatcaccatggctccatctccaccatctgattcgtctccaagtaatctcaaggtaacataagtcaagacagtacagaacatggtgcttgtgccctcaatgtgcagcccccagcctccatcttcattctgcacttaaaaagtttttgttactttctttacacaacataatgagctatacaatatggagaaggacatgaaacacacgcactgtatgcccttttgaattcaaaggttgccctctctttccattcttttaaagatgttctacatggattttttttaagggccaaaaaggaatgaatttctcgttaggggcttgataacagaaactgagaacatgttctcacatctgaacctctccaaagtctgacagcaaagggaagtaaatgcacgagcaaattagttcagcagccgattatcagcttcagcaaatgcaaatctctcatgatttttgaaacagattttacgattttatcacgaccgaagcacacatgtgtattgaaatgacagatttatctaagtaagtttttcagagttatttgggcaagttttatgtccttgcctgatgattatagagataccggcgaatctccttttgatgttctgttgatagcacagtatttagtgcaccagtcacatgcagtactataacctgggtaaaactgagttaggaatggagaagtaaaatgtacagataatcttatatagacaaaaggaagacaaatgtatgtgatccatattttctttacaaaatgtacaaattacatgcaacgattgcatgctggcacttggcgataaaattgatgcttgtctgatgtgaactgcttttaaacagaaatgcaggttctcttctaagggaaaaacacaaacaaaaggccagccattgcaagtgaaacaaccaagggactacaaaattaaaaaatggttagccaagcatgaatctttgggcagtactctagcaagtaccaaccaacatcaaagcaaggatgctaacagcaacatactagctccgagcagtgctttggaatgttttacctcatgaaagaaattgtgaatttagctaataacgatgtggatgaatttcaacagatccattttcccacagcagtgaaaaggaagtaccaagcctggaagaaggaacatgggaccagcataatccccaggccagtgtccatcatgtgcctgaagagtagaataacgccgaatcgcccttttcaaagaggtcagcaccgcttcttctgtgacatcttcatcctcgcccagcttgataccaggaatctccagcttagagggattcgatctagtgaactgcaatttgcaaaatggtattaacaagttaccactatatatattgcatagtaacccagagaaattcttccacaaaatgacgaccacgattgtgacggcagttcaattccatgaataattgaaacaaagtactccaatagtttatctaagtagtagtagtaacttttgcgattttattgtactagtgacagagtgactgtcatcatcgatcaaaacctagatgattaacaagcccagatctcagtgccgtgcgtctccgcacagctaccgaatccccgtcaccccaatcccacagcccagacatgcgtggcgttcgtcgccacacctcagtggctcgatccacccgtcgatgcgtgaaaatttgaagtgcggagagagacgtactcagctacgcgtcggagctgggcgtcgatcccgtggaggaggccggcgctggcgagcgcgccaagcctccgtggcggcggtgcggccgccataccgccgccgccggtggtggcgcgacggcggcgaatgtatctgcgcctccgcggtgatgggaagggagatttccaagttttattttactctttttatttttctaatagagaattttctcacataattatattcggattagtttggttatgaattggatgtagagtaaattaaagttcaattttattactaaaatttcactttataccactatttaaataatacattttttactttggattaagtaaaattatatttgttgtaatttggattgcctccgtcttctcgagtagtatatccatggttttcattataccggcttttttacattaggaattcccctcctgaagctatatgtaggccatacctttaatataggattagttggtatgaagagataagtgagctgagatagtctaaaccagtacagaggtaacattaactagtctaaactaaaatgattagataaagagtggtccaacttaaaactttgataatgaaagatagtcaaagtgcaattcaatcttagatttatatacacgactctttacatctatttccacgtatataattatattttgtacataatgtatattagatatacaaaacgagtgttgatatataactcttatcttatgtttctatagatacaattgtacttatcaatctagattcatctcaatataatgatttgttttttcttcaattaatatggtaatatttagacatctagaacgagtatggtgactcattttcaaacaatattaatataatataattataaataaactttttttctaaccgtatttccaaaaaacctaattaaacataaaaaaatatatcgatgggactggaagttggatgtgtgtttttcttacccaatccaaaccaaagttgatttcttcggttttgctatacgtttatgaacaattttattcatttaaatcacacgaatgtaattataatataattatttacattataatgtaactagcatatataaaaagtgttctaagcatataacatataactagtgtaagtcccagatagtacattacaaaaaacttttttaaacatgtgtctttttatttgcaaaaaaaatttatatggtataatattctcatgcatatattatacttgcaatccattacatgtacactctttccgtatcaaaataactaaacttacgatgaaatatgacccatatctttagccaacgaatctggatatgtctacgtccagattctgtcacattctaaattgagttattttgaaatgcaaggtgtatatgtatacaacctgcaggagcaggagaaggtcggcgctgtgcttgatctggtgtcgccggcgggtgaactcgcggcgcgccgcctcgacctcctccgccgcggcggcggcgtcatcgtcatcagcagcggcggcgtcgaactcccagacctgccggccgacgtgcgcgttggtggagctcagccacccctcgccgccggcgccggcctcctccgcgactcttagccgccacattatgtatatatgacagtatctatatatgtacatacacactatatattcatccatatatatacactcaaccaaacgacggaaacgagcgatctagctgcaattaattaattagcaaagatgataataataaagtataggtagctcgcttgctcgctaactccggatgtgttgttctgagctgaataatggaataaaatggacttctaaatagatgaataattcgatattacaagcaaatgaattaattaactgttacgagattgaaaaatagatttaagataatattttaatagatttatgtgtataaagttttctaaaaattacaaggttagttaccagcttgagaaacatgcttactactctcatactggttagttaccagctggacaaagaacaggggtgtgatcttctcctgctgcaattacgtaggggagcttcttctttcctttttgtttttcggggagcttcttctttctgataagcttgagtaatactccgttctaaaatataaggcacaaccacccttaacctaaaaaaacaagaaataattattatcatctcctagtttggatcaccctaataaatataatgcatgcatccaatgaaattagagatcttaaggtggatgatttaaaaaagtaataatttaatggagaagatgtcctaattaattgtatgtatgccttatatcatgaaacataaaaaaaaagtagttgtgtcttatattatacaacagaggaaatactggacaaatgattttttagcaaactgggtcggccaaagtcccaaggaaaggccaaccgattttaattctagatcaaatttatatactaaaccccttatcaattcgaggcagatcgatggagatctgacgctccctcaacagttcaacacattattttttggtattctacattaaatattgcatgtatataaagacaattaacaaagtcatctctagacactattttatcttatcagtttaggtgttccttcctgtatagtgacaactgacaaactgacgagtatcgttcatgatactgtatcagagttaggtatttcccattaattattattatgtggggaagtgttgatgcagtaatagtaatagtatccacatgcccacaaagtcacaatttttttctaatcatgcatgcacgtactaacatcatgtagtagcattataatttcaattcaattctaccctcaaccattctcctatgtcctccttaggatatcagcaatattttcttactaattgatactccctcaattctaaaatataagatataaccacccctaatctaaagaccaagaaaataattataatcatcttgtagttttgtagtttagatcatcctaataaatataatgcatgcatccaatagaattagagaacatgagagtggaggatttaaaaaagtaataatttaatggagaagggattatagttaattgcctacatgcatgcatgccttatattatggaacatctagaaaaagtggttgtgccttatattatggaatggagggagtaataagtaaggtaaggcttaacaaaagtaggtctctttgttatcaaaattttcacaatgtgtatgaggcaataagatgggtctcatgaacataaaaaatctaatagtctaatgagaaagatagaaagaagagagttaacacatagatgagaaaataatgtttttttatttcttactaccaggttatagtgttattgcatggtagttgttggtactatttccacaattatttactacttactataacggttgcatttatgcttactacctggttttagaacacattgtggatgttcttagagtataaaagcaggtagtaagcaataaaataaccttacaaccacaccaacaaacattgttaaagctagcaatagcaactatgtctgctaccaacaataagcaacttaactatagtatttatacagtgagcaatgtgcgtgcagagtatgtgaggctagggattttggtctttttttcccctcttgtggactctatcttatgttcaccttttacattcacacattatgacatagagtatgtattatttccctaaaaattagagtatgtattagctactacccactgattcgtaaatccaccttattaccaattttgacaataaacattactattacccttatatctatatggagggaattgacttttgcattgaccttgcccatccttatctaaaaaaaaattaaccttgcccatacgtactgtaattactcctcactcttttagactgatgtgattgtgacgtttataagctagttaagggtatggttcactacaatatgtcttggacgcaacttccctaacgtaaagtcagagtaacatgggtccttgacaggtggagctgacatacacagaggagcctcacctgtatgtcccccatacataaaagctttgaattctgtctcctcacccatcttccacaaaaattttcacccaactcggcttgtcagcttgttaacaaaaatagtccccaatgtaaaaatatatatacgccctccgtttcatactataaatcattttaactttttacatagtcaaacctttataagtttaaccaaatttatagaaaaatataataatattttaacacaaaacatacatattatcaaaatatatctaatgttacatctaataaaactaatttactactgtatatttactaagtttttctagacctaaaacgagttatataatatgaaatgtagatttactaagtttttctagacctaaaacgagttatataatatgaaatggatgtagttgttgacagaaaacacgaggcatgggagatctgcttaactccagtacaggtcaaaaactcgccttcaaatgtataagcgtgccagttgatttgatcatgtaatcaacaagaaatagagacaaagaattcgtggttaaatctataaatgatagccaatcggctaggtgccgatgacatatcatttatctttgagccaatgtcatatatgaatcaatcggcggttataaatagatagtaaggaactaaatctatttgatcggctgtagatattaacgatatatagttcttatattaatatatacttaaatcaagtgattgggatagatcggtcaccatgctgagacagtataaatcacttagatcgaaatatatattaataacaggattatatatgtttatagtatagccgatcagatagatctagcatgtatcggctaatactcagatactactttatataaagatatcaaaacaaatataatataccaaacaaaagcttaatatacttaaatgcaataagatcctgatataaagggcggatttaacatgtcattgaagcatatagatcgaatatggttaaatcagataagatcggctgaaactccgatactaccctaatcgacaaccagaggacaggctagagattgatattctaagcacgacttaatagatcaaactcaactgatgcagcattaagtatgaaaagaagaacaatatctagacaatcaagccgctgggtgtttcataaagtggtagatatcttatatgatctaggacaacgtcgctatttaacctaatcggctgccttctattaacagatgttagccgattgtaagttagatgacgatattgccaaggattatgtaagatatatgataacttgatgaattatatagacaagattagagtgtcataaagatggaagcactaatctcgagaacacaagtcgtcataacaagttttacctcttgttgaagatcgaaaccgatgcagctcaacccgaaagcaagaactcgtcgaaacaaaactaaagtaaaaaggtggcgatgcgccgaaattgtattgaacgtgtgtgttaaaaattacatagggctcggggtctatttatacccgagaattacaagatatgtccataccggacacgaccactatctctaacaaactctaagataccataagtctttgcggcagatttttggccaaacatatctctaaggaagttacataaaacatcctaattaataaatacaattgccttctcaggactctatccatgtgcggcaatcatcttgaagcacctcaattcaacccaatgtcatacaccaaattatactgtcagaatcggctgcatcggctcacctagtccgactcagacccagccgaccctaatcgtagccgatctggacttcagtcgattcttactctgttctcggatcaatctccgccttcgactctaccttgatctaatctccttttccgatgcggatattaccaaatttggtcgttaacagtagtatacgacaaattatatactacatttttttcaaagaaatgtcgatagaaattggagtaggtggcggtggcggcagttttgcatatggaacccttgggcctggaacccatctcaacaccctctttccccaccggttgccggcgacgtcgccgagggtttctctaccaacaggaacacgtgtacgcgccacagtggcccgcgtccagcgccgctctcctcggccaccaactccccagtcgcctcccgccccaacgaccgagagctgcctctacggcggcagcggcggcgccggcgacgatcagctcagctcaccaaccccgaagcttcctccgcttcttccggtgtctacaaccatgtggatgacgtatgcaaacgcacaaacattttgcattagcagccggaattttttactgttcatcgccgcatcatcggaattttttattgcgacttttcatggacaaagcgggattagttgggagcatttcaatcaatcaatcaatccaaccaagtcctagttaattcgcctcgggatccgccatgtccaccggcgacgacgacaaccacggcgatccgctgcagcagcagccggaggaggaggacggcggcggctatggcgatgtcgccgtcggcggggggttgtttagtgtccccggttacgagtgggcggacgtggcggcgctggggccggacgtggccggccgcgccgtgcgcgtgcggggcgcggcccacgcggtgcgcgccgtggggcggcgcgtcgcgttcctcgtgctgcggcaggggtcgtccaccgtgcagtgcgtcgtgggtggcggcggcggcggcggcggaggaggagacgccggggtggcgcggttcgccgccgggctgagccgggagtcggtggtggacgtcgccggcgtcgtctcgttgccgcgggagcccgtccgcggcaccacgcagcaggtgttcgacgttttgccgctcccacccatcaccaccatcccgatcacctctgcagtctgctcatggctactcttctgcaggaagtggagatccaggtgaagaagctgtactgcatcagcaaagcgactccgaatctccccatcagcgtcgacgacgcggcgcgaagcgaggaagacgtcgtgaaggccaaggctgtaagcttttttttgtcaatccatacactgccattgatcacagcaaacaatcatgtttcgttggagctatcattgtgaacttaattgtttcgttgcatgcacaggccggcgagcagctcgttcatgtcgggcaggacaagcgcttggacttcagagtgatcgacctgcgcacacctgcaaaccaggcgatttttcgtgtccaatgcgaaatcgaaaacgtaagatttgcacattgaacacgggatgatctcacggaattacccagaaacaaatttggcaaaagaattattcaggaaccgaatttgcgaaagaaaaatcttcagaaaccgttggtgtcacaagaatttgtgatctgatgagcgttgttgtcacactcttggacggtgcagatcttcagacaagtgctgctgtcagaaggtttcgttggcatccacacgccgaagctgatcggcgggtccagtgaaggcggcgcggcggtgttcaagctggactacaacggccagccggcctgcctggcgcagtcgcctcagctccacaagcaaatggcaatttgtggtggattcgagcgtgtgttcgaggttggccccgtgttcagggcagaagactccaacacgcaccggcatttgtgtgagttcgttggacttgacatggaaatggcaatcaaaggccactactctgaggtaatttagctccgttgtttgtgaattcagctgtgtaagtgatgtagctgcatgaacagtgacacaattttcttttgcttctcttgtgagaaacaggtttgtgatgttgtggataggctgtttgttgctatgtttgatcatctgaacaagaactgcgccaaggaacttgaggccattaacaggcagtatccgttcaaacctttgaaggtaagcaagtttatggattcagatgaaagattgttggagctttttgttgtattttgtactccctccgtccgtttcaagttataaagatgttttggtcaaagtaaaactgctttaagtttacaaagtttatagaaaaaagtagtaacatttttaacccaaaacaaatttactatgaaaatatattcaactattgatttgataaaactaatttagtattataaatattattatatttatctataaatttagtcaaattcaaaaacagtttgactttgaccaaagtcaaaatattttataacctgaaacaagggagagtaatatttacttgatgtaatcgtctgatatcaataaaaacttcctttatctaaaaaaggaaaccgatcgatctaccacaagttaatcactggcggatggtttcagcgtcaaagttgctcagaccgggggcttattcatttgtgcataattatgaatcatcatagatgtgatagcactttgcaagagcttattatacagaagaattaaccacaaatggggattaattattgcagtacttacccaagacactgcgcattgagtatgacgaaggcatccggatgctcaaggtttgtgttctgtcatctcaactgcacataaaccaattcttcttgcaaactgagattcttttcttctttctatcctctccttgccgtcaacaaggaactgaaactgattcaactaatgcttgtgaattatgatgtcatattgataagaaatgtcagtaacaaatccaattgacctctctgacaggaagctggggtccacgtggaggccatgggagacctcaacacagagtctgagaagaagctgggcgagctggttcataccaagtaacctttccatcatctcatctcactcccacatgatggagaactactagcttgctgttgagtgttgaccactggaattgttatattagaaaatcttacttagacctggtttggttcccaacttttttttcaaacttccaacttttttatcacatcaaaacttttctacacacaaacttccaacttttccatcacatcattctaatttcgatcaaattttcaattttggcgtgaactaaacgcacccttactagtacttggtattcttcaactgcaggtatgacactgatttctacatgctctgccggtacccgtcggcggtgaggccattctacaccatgccctgctccgacgacccacgctacagcaactccttcgacgtgttcgtccgaggtaattgacaaaactcatctcaagataccaccgatcttctcctgagactagatcattctctcgcaatttggagggaaaaaaatgaaataagattttctggccatggaatacaggggaggagatcatctcgggagcgcagagggtgcacgtcccggaggtcctggcacgacaggcggaggagcgggggatcgacgtcggcagcatcgccgcctacgtcgacgcgttcaggtacggcgcgccgccgcacggcgggttcggcgtcgggctggagagggtggtgatgctcttctgcggcctcggcaacatcaggaaggcttctctcttcccacgcgaccccaggaggctgaacccctgaaaacaaaaaaacacaaccaactatccaccccaaaaccaactggtttctttcatgtttgtattttgcgtggcaagaattctatctgaacacaaacattcgattcaggaatccattcatctcgaacttgtgtcaaaatgcgtttctatttgactacgctcgcgtggcatcactaacgggagaatacatatagccacattattacaactgaaacatagctacattatttcacgtataaatacatgcacattgttggtgctgctgctctgctcgtgctgaactacttgtctgcggccaagacgcggcgacggtactccccaagggcccaaatagggaagatgtttctatactcggagtagctgatcatgcagtttttgttgaagactccaatgatctcctgttatatggttggggggggggggggtaaaaaatgttatttagcatctcggatgatggtaaataatacatagtgaaaggaaaaggataactcatgtcagcaatttagttttcctcgttcaatatcgagtgaagcaatgcgtgttcccctagcatcaaagatcttttaacaacattgcgcaatgatacttcaggataatttccaagcaactttggatctatggtcgaccggttagataacatgcctagaatagtctaatgattagaaacacgcaactaagggacaaccctcagtcaattagtttagattatattgcttgtcaatacctaaaccctatatttctgtgcttctacttatgcccattggaacttctatgaaatgctctatttttaaaaacagaagtttgaatcaccacaagattattacaggctgaagtaaatgcatcactttcttttctagagcaacgtttcatgtcatgaacccatgggatggattagaacttacttgctggggaaattcaccatcttccgattgtaagttgatcaaaaccttcgctgctcgatgcaaaggaattggatctctctcagcctgcaagaggaaagtactatcacgaataagcatatgtatcattttacgataactgaaaagtcaaccatacacaaaaatatatttaacaaaagacaaacctgccctgcatcgattagggctagcatggcccaaccagtgttcaccgcatgaggtcgcttcccttcgagattggtataaacctatttgaaaacaagccacgagatggttaaagcaaagatgaaacctgtgtaaattaagaatcaatacaatacctgatcaatacagtatttcaagtgctgtctatgtgcaagacaatgtccaacatattatttgtaaaggtaatgttctaatatgtataaaaattcttacatgccacatggattacaaagaaaagaaatacaccttaatagttgattcccaaaaatatatcatttgttgttacatatgaaagcatgttggtagtagtcactactaatttaatcttttaagactggaagaaattcaagtgactaagcaggtggcacaaaaaaacagcaaagaaccctgcaacacattataacctacctgtgcgccatgcagaaaagagcaatggcatgaaatttagcatcctactctatccagtacaacaaaatgtagcaccacaaggttctagttgtatcccgattgtagggaagttctctcatgagttcatgtccacttgttaaaactttacatgttttgaagcatttatcccaaacaacaggtgatattgatcagagcacctggttatcaacattataatagatggatgcgatccagtaaacaagattgaaagcatatccatgatacagaaaaaaaaaaagtaaagaatagtaacattgtgcaaatttcatagaaatgaatttacctgatcttgggatgacaaatagctttctccccagcctccagaaggaagctcttttgacaacaaaaagtcacatgcctttctgattgcaggactgtttttgaatgtcctaccagcagcaactaatccctttacaccaaaccatgtgccataggtaaaacaaacagcccaagaaccatacctgttggaaaatacagagtgaacaatgtagacaattttttttttgaccaagggcagtagacaatgtagacaattatatgcacgcaatgttcttattgtttcatgtgaagtccttgtactaaccatgaaccatcgcttttttgaataccctcaataaagctagcagctttgcttatacagttgtctatttcactcttgcggtgtccagggtagagctttttaaatgctgtcagggcctgaattgctgctgaagtgcattccacataactataaattttatacacatacaaaggagagaaggaaagaaagatcagttcaccttctacatggcaaagcaagaaaagaggacaatggatgggttgtaatgtcttacggataatcaatcacaatgtccccaaaggtctcagcaggattgataagctggaaaagttcaataacgcgtgtcaatattcatgaaacatagtcaacagtcgcatggaaggatgttccatagtcaatataaaaatattacagccaatggttaattgtccttttcaaacaaagaaagcatctaatcaaagagctcaacaaatctttattatattgaacaagattacaagaacaattaacaaatttttaggtgccatcttttgagtcagcaacttcccagttttgatgtcagcgcagaaattgacttgcagcactgcttgcctagacaacaaataagagaaggatagtcctcaaataagataattatactcacctccagccaggcataagaccttgtgagttcatatgttgcaaatccaccattatcattctgtcaagagtacaaggatctgtaaggtaaggttcctcccaaaggaacatgcatgtgatatatttaaaacaccaattaaaatacacaagagaatgggggagctattggcaacaaaactttgtggagcactggaacttcaaaacattttttttttgaagaaatgattatatgtcgtacttcaacaaatctagtttgccatagttctatgtatctttagagaatagttgagtggagaacccatcaaacctgaatgcccggtacaacaaagtaaggctgcatgcattagtaactcttccttcagccattaaactgctatattagagacactttatagccatgacaaattagacgtcttatgataattgataagcacaaaattataatgtgacggatgccttttcatacataagggtacttgcagattcaattgttaaacaggagtccatttaccacatcccaaattttaattatcaactgaaaagcagatctccaatattctaagtttctaatgcatattaatcagggttgagaagcaaaaaaaatcgtttcggtatcctacagaaatacgaggtgcttaaaaaagggacaagacaaacatcttctctgtccttgttctgaatgcaaaaggagcacttgaatataggcatacactatatgatgcttactgaactgctgctccaaagcttcattttttttatatattattcatgttacatatgaaatgttaaaatgacatgagaggtttacaatcacccttaaatatgaagactgattaaaacttaccatgtatgacatcaaacaattgacagaatcatacagtctattaacttccactgcttcgccaacaatatctggagaaatcttcgatagcaataatgccgcctaataataaaacaaaacgagaacagttcaaactattacaatgtcaagaataccagcagacaattgctatggaacagactaaactttacagataagatcataagagaatctacaatggttcttaataactatttctcatgcataccagagagtttatatatgctagaagagtagaagaacaatattttctcaagcttgaaagataaaatttaccttaagtccttctgcagtgcaatctgatataggccaaccatgatcagcagtagaaaagggccatgcacctttagatatgtggcggtaccactgactaagatctccagggcagtcatcgataacctttcaggataaaagccacaggtaagtaatgagatggcttgaaatgttgattagtataatcgtataagggaacatgcatgaggcatgcacctgcgttttctttatgtagccatgtgctagtttaagagtaggaccaaattcttcaatgaggccagtagccactatagcttgaactgtgaaagctgtgtcccacagctggcttccattataaccctacagcggtcacaaaaagaatctatagttaaagtaaacagaacacacttgatgcaatgcttctctaaaattatgctatgttaaaaacttcattggcagaaattatgccaaaacaattttccaatggcatcaatagacagtaaatcacacttgttcaataggtgtcttgtgccaaagttaccaactttcttgttggaagttagagtaaagaaaaaaggtgacctgcattttcatgccatcttctgcaatccataggtaatcgtggactcttggaatgtggagtttgaatgcctctgagtttggatcttcaatccagcaagcaagcatatttaatacctgaatagagagaatagatttgaatgacaagaacacaatgtattgcctgacatgactgagcagtttaattcatcaggtattaaagcatcaagagtagttacatcttatagctacgggaggaagaaacaaaaagaaactccataatctgaagtttaatgaaccattcaaaaataaattgcttctttgctacctatatatgtcttcacaggactataataggcttattttggcagaaatgttcatgttttaaaacaaaagaaacatagaaggggaagaagaatgacagtgaacttgccgcttgagagaaggtagtgcaactaaaacatttttaatctatataggccgcttggtggccacccaaaaaaagggtggtgcgaggagccatcgtcgctacaataaaatagtaaaccaagataaaaaaaaaatgggtgaaaatttaaaggggaatactgtaaaacacagtaattatgacagtttccctctaattgcagctgcacatgtattccattcaaagttgaaaattgtaagtgtgtacccatataatggaatggtttcccttttatgcctgcagcaagaaaagaaagaacgacccactttcttttgtaatgaaccaataagcaatcatagtcttcaaattaccttgtttactggaccaatgcaaatatatcgggtgttctcatcttcataatgaatatgctgcatgacagtgtccaaagctttctccctcaatttgttcccaggccaacgcaacatagctggttcaacaaatttgtggagagtggcccataatacatcctgcacgaatggatgtggatagtacagatcttcctgcaatacaatacccaaaaaaaaaaactttcagaaagaaaaatccagatcttattaaacacaaagtgataaaagcaagatacataggataaattatgtaaaattttgggcttactacaataacttttcaagccatgcacgataacaactaagcataacaaagtccttcagcttgtaaggagcttaaatcatcagattacgagtcaaagtcatgatttcaactattggcttgtaatcgaccagggaacaagaagaaaatttaaactttggctacttctaaattttaaattgtacagtcatggtaattgaaagttctaaggttatatttatcacttcaataatataatatacttttaagtatttaaaaatgataaataatatggtggtcaaaatttgtgctctgaagtcaacaatgccaattatttagaaacatatggaatacattattcaaaaaaggcacagtttttgcgtccaaaatgtgttcaaagtaagatgacaatatattactgatgattttttaactcacctcataagataatattttaccatactgttgtcaaattatcttatgcacgagaatacaacaaacattaagtaattaacaaaccttagcacatagattgcgagccttgtcccaatcaacttcattgtagggtacttcgtagagttcctttcttaattccaatataattggtgtaactgggcccacaaacctctttccataaatgtaacacataggcaaataaaccatccggcaatgacaccacattcgcccttcacataattataaagtttatcagtaagaaattactagcactaatgtaatctacagcaagcaaagtaatgaatatattatcatatacattcaataggagaagatataaatgcctacagggggagcacaacctggatgaatcggcaggaaatatggcaacaaccatatttctggtggcactgggttgttgccagaccagtcaaatacaccaagcacctgacatgattagggaatataaagagttgttacatttaaaaaccaggttagattattacagcggtcaagatacagagagaggaagtgttaactccctaccgaaagccaaaacttgccccatgatgtaatataagttgctcccccatggtctaaaatccattttcgtcctttctccatagctccatcgccgctatctggcccctccccaagcaatctcaaagaaacatatgtcaacgctgagccaaacatggtgctgtggccctcaatgtgcaaaccccatcctccatcttcattctacacttacacacagaaaaggaaaacattgcctttacttatttcaagattgtagaagtgtaattagatttcttacctgatgattgtagagataccgccgtatctccttctgatgttcagatgacaaagcagtgttcagcgctccgctcacatataatgttataatctgagtaaaatagaaaatataatgagtaactttcacatataacaggcagtatggaacatttcttttcatacaggtcaagattatgagtaattaaaaagaaattccatagttcaaattttagtgagtaaccaaattggaaacgacttgtggtgagttagaagagtaccaagcctggcataaggaacatgggaccaccataatccccaggccagtgtccatcatgtgcttgaaaagtagaataacgagcaattgccctttttagagaggataatacagcttcgcctgtaacagcttcatgctcctctagcttgatagctggaatgtccagcttaagaggatttgctttagcaaactgcagaatatacaaaataaatgcttaaatatcagggatgacatgtgcattgactagtgaaaaagacactaatttcatggctaatacatagaattcagggcaagccaaacagaagtaaataaatgaaaaatattcagcacaaaattgcacgtttaagatattaccggacagtctataaaatcgtgacgtcagaaagttacctccaagtataatcacatttgtctcacttttttactgtttgcacatgtaattggtattagacattttgaagtaaaaagtacctgagttctctgcatcctacagtcctcataagaggctaaaaacatgctaacccagtttgatttgcccaccggccactgcacattaaaagctactttgagttaaggcatatccctatccagccagctcttcccattgccgtccccacaagaacccaaatttttaggtaatgaactggatggaggccccccacatggtacttcaccagatccccaaatttaattccaagctactcggtgcacaagcaacccggaatcaccaaacaatttggatgcagagctctcagggaacactgaaacacagacaagacaatgataataaaaaaacaagaattcactagtgcagggcatcctactactgctaattaacatggatagcgaaacatctctatattgtcaatgggcaactctgcgccgcaacctcgaatcgtatggggcgtatggctggaattgaatgcagcatccacatcaaaatccaccactggaacatgcaaacggatgaggcatagcgaaaagggaagagatcgatcgccggcttgcatcgcatccaccacgaattctagcacgaataaggaaaaaagaaggcgcgtgcaagttgcgagagcccatctccgctcacccacccatccacccgatgcgcattaaaccgaaatacactgtatctgaaacagcaatcacatcatcaccgcattgaacgcttccagcgacagcgtcgcgctcgatcggtgacgccgcctcccgcgagagaacaccgcgcgcagatgtgcgcctcgccgcctccggccacgagcaattcagacgagctaagcaaagggggtagtatatagtacagtagtaggagcgagagggtggcggcgcggggagaggcattttacctgcatgcgcatgaggaggtcggagctgtgcttgagctcgtggcggcgggcggcgaaaccgcggcgggcggcctcgacggcggcgagctcgtcggggtcgcccgcggcggggtcgaactcccagacctggcgccccacgtggccgttcttcgtgcgcagccacgggtcccccccgccctccgccaccctcagccgccacatcctccccccccccctccccctcctcgccgccgatcaaccaaccaaccaaatcgacggcgtcagctgcggcggcggcggcgagagagcgaatcgatcgggagcgcggggcggcgcacgagcacgagataccgccgcgttataatacggaggagcggcacaggctggaactagtggtgatctggattctggcctgctgggttttttttttggctcggcttgggccttggggcccactctttctttgcggttgtgtggtggtgatgtggcactgacagattgggcccacaaatgccacgccggctgtatgaaaaggaggtctcgtgggctgtgtccggatccggaatgtctgtttttcttttcaaaaaataatactattacttccatcccatattacttatttatcgctttgattttttatttataatatctgatcattcgtcttattaaaaaatttagaattattatttattttgtttgtgacttgtttggttatcaaatgtacttcaagtataacttatcttttttatatttacactaatttttcaaataaaacgaatggtcaaacattttaagcaaaaagtcaaagcgacaagtaatatgggacgtgaatagtactatatatagtctcttcgtttttaaatatacgacaatgttaattttactcaaaaattttaagcaagatcaaatataagttcatgcttaaaacctttaataaatcaagtcgcataatacgtaatttttttaataaatattaatggttaaacgtatccaaaaagttaatagcgtcgtatattaaaaatagaggttgtattatctcaagtggttggtgcgtactatctctattctaaatatagtaacctatattagacacatcataatacaacgaatttatagtatcttaaaccctgggtttgaaaagctcaaatgtttttcacatatttcaaatgaaatttgtatgaacagggaaagatatttcatgctcgatagatttcattatacaccactcaatttgcaaaccttttcaaatttgaaattcaatgtgcacgcctttttaaattttgccattgaggatgtgaattctttcattccgtgccgctttatccatttgacgtctgtccactaccactgcatgataccatgacgctaggcaccctccgcgaaggcctagcccaatgatagcataggtggtgcccaaactcaagcccgaggacgacgtaggcagagttcaaggtcgagccgagttcaaggtcgagccgactggtgacatcaatattggaggttgatgtcgagcttgggacggtgtggccagaggtcaagtgtggggatggtgccaagtgccaatggggatcgaggtcaaacctaggattacgcaagcaaaagactgaactcaacgatgaaggttgaggttgagctagctgcccgaggacagtggcaacggggcaccgatggaggttgagcgagctagtgaccagggcacattgcgatgcgctaatcaacaatggttgtggtgcgcgacgacagtaggccaatgaacgaagtggcacaaaatgaccgaattcgcgttctcggtggtaaattctaaaagccacacaaattaggtggcaaatttcaaaatgtttacaaattaaagtggcgtataacaaaatttgtcggtaccctcctattatctcgaaatgttgtcacctttaaactttttaaaaatgtttctgattggttgaaatgaaaaggcaagtggatagatatctataatttagaaaaggagatttaaatgttaaagagtagctatatgttttaggacaatagattaataaaaatatgagaccgatattttctcgagatataatgggaggtttcgtaagtctatattgatgtggcacaggtcgtagttgtgtggtgttcaaaatttcgggaaggcacgggtcgtgaaagtataaccgaaaatgtgtcgatcacaagttcacaactacccctaaggctgcgttcgggaaaacggagcagcgattagcgggtgattaattaagtatttgttaattttttttcaaaaatagattattatgattttttaagtaacttttgtatagaaatctttttttaaaaaaacgcactatttaatagtttgaaaaacgtccgcgcggaaaacgaggagaaatgttgggaaatggagggaaatggaggaaacgagaagcagtttccctgcacgcaaacatattttttgcgaattgcggagcatccagaattgaatacgtagcttgtttgatctttcttttttctttgagttgcttgtttgatctgtctagatgctgactacatcgagaaaatggacatttggccatcttcaaaagtaggtttcgctattatgccatcttcaaaacgtgattcaataaaatgccaatctcaagcctgcactgctatgagaaaatgagaaaatggcaatccaacgagtaggggcttgagattggcattttatcgaatcatgttttgaaaatggcataatagcgaaacacagttttgaagatggccaaatgtccgttttcttgacatgtccattttcactgggcactgccatgagctgtgcaactgtaaatctgtaattcttgcatttttctcatcttttgttgattgtaacatctgtgacttgtttgccatcaaagaatggttgctgcttttcattttttatgtacaatttatactggtttacttgtacatggagtagatggatataagaaagcacagggattaggttatgccatggggatggcatttgaaaaaaaaaattactcgcatataaaatgcgcatatagaagtagtatgtgtacatgaagtttgaaacaatacttactgaatcttttatcatgtaattttgttattgatcagtccggtaatgtgcaagttaccatgagtaatttcttacatgaagcttgttaatttgaagtttggcgtcactcgaattacaaaacaaaacttccagattggtatttactgatatttttgcttaaacacaatttgcgtgcacagctgcagagaacaaaaatgctgctgaagcatcaaatcaatgatctttacatgacctttgataataatctttacatgacctttgattcaggaagggaagacaaattgagagcaagaggtatggtaggactggagaggagagagccaattgtttgtcatgtacatatgattcttttctcggtaattaactccgaaagaaattatcaattaataaaagccctaaagctaccgattctctcttttttttgaaatattatttttttttgctcctcgttaggagctcctcgattgggtgagctgtggagcctttccttttctctctcttcgggttccccatcggttctgccggtcacgcgctgcatgtgcgtcacgttttgcctccttggagcaaatgacgcgtgctgatatttatgcaaaaaaatcctcgtgtttgaacggaatagcgtgcactgcctcccaccgactaacatcacgttccattttatacgaaacaaccctcgtattttatagaaatacaacacgaagaagatagagttctactcttagggggtagcgatgtaaacataaaaaacaagaggttttttccaaaaaaaaacatatcatacctatcccctcccctcccagctcccacccccaaactctatcctcacatcccctccccacgacgcttcgccgccgcccctcccccttgctctctcccctatcccgccgccggccggcaatggggcatgcggcggcggctgacccagccgcgagcgccagccgtccccatcaggaagccgcggcgggcgaacagggcaagcagggagccggggagcaagaaatcgtcagcgtggaggagcttgcggaactcgacagcggcgaccacaacaggagcttggcggcgatgccggtttcgaccgcgagttcgccacccctccccacctcacgcagatcgaaagacgtggagctccaccacccctcctcgcgcatcgccgcccggccgcctcccaactcctcccgtgctgcgccgcggccctctccccgcgcgccgccgcccggccgcctcccacctcctccccgctgtgctacgccgctaccccctccctcgcgtgttgtcgccgtccttccgcgcgccgcctcccacctcctctccattgtgctgcgccgccgcccccttcctgtgcgccgtcaccactgcaggttcgtatgaaggccgagaaggagaaagagaaggaggattttccggtgatggcgatggtggcagggctgccgatgaggatggggccgaggggtagtacgaggcgtgggacctctccgacaatgaggcggtgctgggcagatcttgggggtggaactccgcggggaggcattaagtaggtcagcggcgcggaggagctctctgccctcgagtcggcgcggggacggtacagactttgttggcggcggcgaggaggagcaaggcggagctgccgccgtgcgggcggcattcggtggcccgtgcgacccccccccttccccaagtgacggcaacgggggtcctccggcggatccgtcgccacacgaccggccttcggcagcggcggatccggacgtgcgcgccctatgcatatgttagcgtgcgcggcgtggcgccgcgcttatacttctagtggatttgatttgcataacaatacaagtcctcggactgtccagctgaaattagccatgaagatataaacatgcactttaagtttagttcacaacccaacagcaaaaatgaaataataataataaagctgaaactacgacttacatgcaaaaaccactacatagaacggaatcatatgcaaaacctgctttcttgtatagagcttgcaatcgtaatcaataaacaaatatggttaaattcaatcaagtggtcttcttctttttctttgacttgagcataacaagacccatgaacacgcttaagaaagataggagaatcacgccagcaagcactgggatcaaaatagcatactcttgaggcagaaagtacttgtggacgaagtgatcactgtcaacaaatggctatattgaaaaaaagaggaacagcttatcatccagaaataaaatcatagatgttatatttgaaatgaaaaacgcctagatgttactaaccaggatgatgacccagaaagtatagtatgtaaagatggatagacttgtcaaggttaaaataaagcctactgccttgtcccccaattccatttgtgcagatattgtacaaatctaaacttgattcagatgataaaatctacttcctacatgcacacaaaaacagtctgcattagaaagcacaccaaatatcgaattgcatagaagtaaaatctcatgaaagttagtcctatttggggaaataaaacaagatataataaacccaaagtatttatacagcacaaaggtggcagaggtggcaacgagatggagacggagagacagtgacaggacctcagcagctgcagcgtcgtccctcacacagtggccttaataggaatacaacagtttgcatgttagttttaaccattcctcataaaataaattatctgaggaagataataagataaaattcagaaacaatattcaggtaagtaagtcagtgtgttatcataaaccctataaatcagagtgttcagagccacatggtattctgaccagttcccaggcattttcctagacaagtttatactcccaaaactttgctagtgaattaccacatttatagagtgcaatgaacttacccatgtgcatatctcaaaaatcgaatgcagtaagcacaataaagaatgtaattaaatatgataaaataaaatccatttctattagggtaatgttataaaattcatgacccacataattttagtagccgttccatggtaaaataaataagagcattaggattccagtggcagttgtaaataaaatccatttctattagggtactgttataaaattcatgacccacataattttagtggcagttccatggtaaaataaataagagcattaggattccagtggcagttgtagaagccccatcactgcttgtactcataattcttctgaagcctagcttcctattgctttgcactaaggtaagaatactctccttatcacgctttctccagaccttgactatagtaatgtgcagcacagcagtgcagataattttagaaaaagattatcctggaagcaataaacacaactattccccaagaaaacctgctgtacatgctacataatttcttgcctcaatcaccgtgtatgtgagttgttagattcaagaattttgggtcattggatttgatgaatgaggtatgtaggagtgaagttggtgaattatagggtagataatcaaggttagcagtgacctgatagagaaataaattaaaatgataaaatttgtcaatagcaatgctatgtcattgttacattttaaaaaaccctcagtgaaattagagccatttcttttcccattttagacggcacaagagaatgcattctgcaggtagtagctgaatatatatcatgttataaaatcccactcaatatctctagcatcatctcacaattaaaggaaaggagtaatgtaagatactaagattgcttaacaatttactcagatttattatgtattgtcaattctgaatcgaaccaaataaaagaagggataatttgcttgctttcgttcaaagtgcagaaaacaaccaaataaaagaaagccaatccaatcacctacttgtttaccgctgatccagatggggatcctgctcccgtcgccgatggcgatgctgctgttccggttggaggggagcggtccgcagtggccgtgaatagaggcgcgaccagtgagatcgcaagcgaagatggtgaggggaccgcgggatccggtgctagatgctccgagacgaccagggttggggttagggttagggtttggagagcgagagcgaggaagggggcggggggcgatgcgggactgtggagcggggcgcggggggattggggaggcggatttctctatcaggtcaggaggggcggacagggggtcgacggcgcgcgacggcgatgatgcggcatgcgacggcggatcggttgagggcgacggatgcgacgacggcgatggggatcggttgagggcgagccggcggcggggataggtggcggcgagacgacggttgcgacgacggcggagcggcggcagtcgagggcggcgtcgacggcggtggcgcagcgtgagagggagagattaaggtagacgggggtttgggcgtaggtcggggttggggaggggcggcggcgcgtgagagcgagagagagggggcggagaagagggcgcggtggagacgatcctcagcgttggattttaagcagagatgatcctgaccgttctacgaggaataaaagaatgagtgatgagtaaaatcatttgttgaattataaggtatatagatagaagaagaagaggatgtggatgctcaccaggatcccctcctgtgctcgccagatggagaccggcgcccctctcctgttcagccacgagatggcgcaaccgtgcaaggagcggaggagacgagtcaggggatttttcttttacgcaaagggaagagggaagatacttgagtgcctcacctttatctcaaatttagtgatgttatccattttatttatcatgactgatggtggttcacagagaaaaaacgcaacaaatttggttgaggatttatatcagtgccgctccatctaccaccaccgctctttctccatgaggcaccatcgttcctcctgctccatctaccaccactgctctttcttcatgaggcaccatcgttcctcctcttcactttcacatgtgcaattgcactctctagtcactgatttgtctttccgcctcccgtattttcatgcacgctattgtcatggtcgtcgttgaggccagggtatcggccttgcaaggactcaggacgataggagctgacctgaccgagagcgaatacgctagatctaggctcctccttgttggatctggcggttcctagctattagagggaaaaagaaaaaggagagagagtgtgtgtatggagtggttgtagagtcactggatttggaggtgaagcaacggtgattccaccggacttgaagatggatagaatggggttgtctaaattgaaacaaaaatataaagttagctattttataaatgaaaataatgattaaagaatgatataatatgaaaatttttaaaaatacgttgtacaaaatgaatttactatttttgtccattagccgtagtctcatgctatcctaagtcactacagatttatcgttactatatggtatggttgggcggtctacttaactattactaataatctcatgatatgttaaaacataacaatacagagttctacttaaaaaaagataaaaaaaataataccctcgattttgctcaataataaagtattcgattgtggtcccttttctcactgcacgatatatcatgactatctcttatatgtattattttccctcattctttcatattaatttttaaattttaggtatatgttaattttgactaatatttttctcataaataaatagacaataaatcattattttatatttctcctataaaatgtgaatagtgaattatataatttgaaaattatattataagtgtatataatttaatgtttgacttatctctactattataaaaattgaagatgtttttgccggtattttggtacatcatctgtgtatgagtcagtttttaagtttgtttgcttttggaaatacatattcgtatttaagtcggttttcaagatcgttcacttttggtaatccataaggaattatgtaagaaatttgtttaaaaaactcgcatgctaacttgagatgatctactcctaactgcatcatgattttctaaaaaaatatatatccaagcgaaatcccacagtgaattttatcttaactaaaccatataacaataatgagattaaaatatacttcacccgttacaacgcacgggcattttttttctagtagataatcatgcaactgtaaaacgaaactctctcatgccagcaatgaccacgcgttccttctcccttgaaagccgtggaataccaagcgatagttcgaactgaaacattcattcgctatttgctgaaacattgtttttatataaggtgaaacaacacccgatttaaacgagtgaaacattttcgatctacttagtgaaacaattccgatatatctggtggaacatcgtgcaatatttaaaaataattcaataataagctaaaattttttttcgtcggaatatatccatgtgtggtcttgttttgaagatttaattgcaacgaatttaatggtgtaatcagatcataatttggataagtactttaagagataaatcagtttaaagtaattttatacgtaaatcgagcgctgacgtcagcacctgattttaccatctcccgattgggcgcccgacccagagtcatctccctaagaaaataccgtctcccccaaaaaaaaaaaagttctccaagaaaaaaaaaacctaacccatcataagaaaccggtaccggaaaaaatcgactcatcataatttatgttccattcatgttacaaagcacggacacctaactcgtcatttagaaagcgatgtagagatgcatcgtactaattaagttgccatgataaagaaaacggtccattaactagaaatagttgcacaaaatggatacaatttactcccagtatttcataaactacctttaaatatatatttatctcgagacaaaacgctgaattatttgtcagagaactattctggtttccatcaatcaatgtcataataacccccaaaacaatttttgccacatgggctgcgaatgtaacggagtacttaggcaattgacaggcctacatgcttttagggcatgtttagttggtgaaataaaaacttttggatgttacattggacgtgtttgatcgaatgttggaaggggttttcggacacgaatgaaaaaactaatttcataactcgcctagaaaccgcgagacgaatcttttgagcctaattagtctgtcattagcatatatgggttactgtagcacttatggctaatcatggactaattaggcttaaaaaattcgtctcgcgattttacatgcaaactgtgcaattaatttttctttttatcaatatttaatgctccatacatatgtccaaaaatttgatatgatgtttttaggaaaagtttttgggaactaaacagctccttaaagcactccaactaaaagtccttattacatgaacatgacatactccagtccttattacattaatgctctatgtaaagaatgaaagctcaggccagagagaaacggtcaacgttattggttgccaagccatacattgaagggttgaaagccccgtagatttcttctgttataaaatatagctatttctaaattcaaaattactctaaaatatagatatttcttcacccactccttcatctcaaccattcacaattatatcctatttatttttttcacctactttcttttcttaaataataattgtcttttactattcaattctacttatacttaatttttattttccataaaattctctagaaatgtttatattttgtaacatatggaatagattcactgttctgtaacgaaagagtcgcgtcaaggacacaagcacactgtagtgcagcaattgccagaaatcgatagccaacaaattctctagaaatgtttatcttttgaaacagatgtaatatgttcattgttatgtcacgacgagagtcgtgtcacggacacaagcacactgtagtgcaacaattgccagaaatcgatagccaacaaattctctagaaatgtttatattttggaacagatgtaatatgttcattgttctgtcacgaagagagtcgcatcaaggacacacgcacactatagtgcagtaattgccagaaaccgatacgccatcaaaacccatctgccatcaaaacaaatactccctccggtttcattttaattgacgttttggacaatgacatggtatacaagatacatctttgaccttatttttctattataatatatataataaataaatgcatgtttacttttattatagtactttaaaagacaaatctatatatgttgttctagttcctttaaactaaatatttttaaagttattgatagtctaagttataaaagtttgacctcaaccttgtccaaaacgtcaattaatatggaaccggagggagtattgattttcagtagacctttcttcttaatacaacactatggaaccggagggagtattgattttcagtagacctttcttcttaatacaacactatgcaactatgcaagtctcttgtaagagttctcattggaccttataactgtaattctgaaagagcccaaaactgaaaacaacaaaagctgcaaaccatctgtgcccaccttcttaaggaagatctcttttttttttctttcccagagaaatttattaagacagtttatcttcatggatacaaatacaacaacaacaaatcatgtttaagtttcactctcttcctatactgtttcccagcgaattatgtttaccaggtcttgacaatatatacaacatcaggtagtatataagtaagtacatatttgtatagggtgatgaggtgctcagtaacatctgtagcatatataagagattcatggcatgccatcgaccccttcctttatcacaatgccatgctcatgcatgcctcttttagcggagatgccagcagtactctccaagagcccagatggggaatatgttgcggtagttggggtaattgaagaagagggagcaattgaagcatccaacgtgttcctaacatcagtacaggagcacaagcaaaacatgagatagaccttaatatgttcacacaagtaatgctgaatcaccttagaacatccccaggagttaaactaattggccatctaattagtttcttttcaagtttccataatgacagttaaagatggaattgtatgtcttaaaatccttgtacagaaggtattgtatggtagatctcagttccttacatgttgcgaagtcctgatttttatctaatgtaaacaccatggttctttcctaaaaaccacttgatttgtgcgaggaagcaatagcccatggttcagttcttttctgaatgtaaacagaactatattgagcagtataatgtaaaatttagtctagtcatattatgtattacttgatgaccatagttcacatcagagaagctgggagaattaaaccccactcctgacatacgatgcattgtataggaggaacctttttttattgtgatgttcacttcattccataaaattactgctgaataaacaaactcaagttttccatgaatcgatataagacatacccccaacaaaactgaaatggggacttacttgttggggaaactcccctgtttctaactgcatattgattaattcttttgcagcacaatgcagtggggttggatctcgctccatcttacatccaaattaaatagttacagagatcattgataaacaagttattcctatcagaattaaattgagaatacaaaaaacatacctgtccagcataaattaaagtcagcattgcccaagcagtattcactacatgagcacgatcacctttgatgtttacatagacctgtttgatattacaaaaaaatgaaaatcaatggggaaatctgcaaaaggttaacatttccaaaaagtgtgttttaacagtgagtattaaaccaagccccaaatatgccaaaatttgtagaagtttgcagacttccctcataaaaagatttcttttgaatggaagcagagcttgttgcaaatgaaaatgaataactccaacatacacaacagatcaaatgaatgtgctgtgcttcaaatcctatgctgattcaagaatgaatgtttgcttggatggcttattttgaggggtgtgaacaagcatgcccgtacagccatattcaagacacaaaatcaacagggtgcacaccattactagtgttatgagcatttgttctacaattctactatacgttcagtaaatgccagttctagttgaatttaaagtcctgctttaaaaaaactatgctaattaacccaccattgtttttcctacatgccaattatcacaaaacttccaacaaaacgaaccatatatgtgtattcaaccataaaaattaaaatgaacaatcaaaagagctagagagataaaaaaactcaccttagtttcattagaaacgtggctttctccccatccgccagtattgagctgttttgacaatataaagtcgcatgctttcctgatggaagaactattctcatatgttcttccagcagcaattaatccttgtactgaaaagaaggccccataggtgaagcatacaccccaagtgcctagcctgccgaataaccaagttattgtgttacaaattgttactccctccgtcccacaatataagggattttgagtttttacttgcaacgtttgaccactcatcttattcaaattttttttgcaaatataaaaaacgaaaagttgtgcttaaagtactgtggataataaagtaagtcacagataaaataaataataatttcaaaaaattttgaataagacgagtgatcaaacgttgcaagcaaaaattcaaaatcccttatattatgggacggagggagtagactagaagagagaaaaaatatccactagtcagtaaaatgctcttgctacaaaccatgagccatctttgcgttgcgtgttctcaataaacattgatgcgtttctaacacattcttctatctcttcagtacggtaaccagggcatagttctttgaacagcaccaaagcttgaagcactgaggaggtacattctggatatctgccaatttatagaacagtatgagttgcaaggagttattttatctacaaagtgaaaaggggctaccaggatttatgtaattgcatcacttacggataatcaaccaccatatttggaaaactctcgcaaggcttgagaatctaggttggaaaaagagaagacttgtcaggcttactggaatggccataagaatttgcaataaaactggtgatttcttcaatgtaaatgtactggaacatacatgacgtgctgaatcaaatagtcgtgttttataatttgaagtacatgcatgttgctgatgttatttcaacatcataaattagattgattgtgttatgatgtaggcacaatcatggagtttttttgtgatgttagggtgttagtgtgcagaaactcacctctatccaagtagaagttcttttacattcatatgtagaaatggtaccatctttgttctgcaaggaaaagctaatacgttgacaaaatcgatttcacatcttaaaatcatgccaacaagaacgttctgaaggaatcacccagactaatgagaccatagttttcacaagattacatatgggggttagtcttgaaggagattacaatttgcataccacaaaagataggaggcaatcaacagcatcatacagcctttctctttcaatgggatccccaaccatgctactagatatctttgtcagcaacaatacagcctggaaatgaaattatgtaagatttctagggtagacataatagaaattatgcagaattgggaatatatcaaggccaatattttttatatgcatgagcttcttcgatgtgctgtcaccgattaggactggattaatatgacactagttttatacctcatttgcctacattagtaaccaggaaaagaacaaagaacataatgaccttcagtgcttctgctgtagtgtcagacacagcccacccattgtctgcagaggaaagagtccaagaaccctttgatctatggcgatgccagtaactttggtcaccaggatgattccttacaaccttcaagaaagattatgcaatttatgttgaatcttatagtcttatacagcagttggtttctaaatttagataatgaaagtatagattctgaacctgggaatttttcatgaattcgtgggctctctgaacagttgaagcatactcatttacaagatcagtggcacaaaacgcttgaattattaatgctgtttcccagctttggcaaccatcatatacctatcatcgagataacaatttatcacagtttttcatatctttgcctgagataaaatagctaactttctagaacaaaaggcacagcaactttagaaatttagctttatagctgttgtaggttggaaaccttcttggtatatgtttaacatatctactgatgtattccctaaatatgcgatgaacatcactgaaagtacaaccatccataggtgtataacctcgtttctctgttaaattaatgacagaactagatagtaacaggaaatctttcctagatgtaaagtatttgtcttagggtagtaccggaagtggacacattaaccatgttagccccacttccacatgaaatttgtcaatttatgcatgaaagacacaaaagtttagttacctgcgccttcatgccatcttctgaaagccacaagaaatcaggtaccctcgcaagatgcctcttgaatgcgtctgaatttggatcttccgcccagcagcagaccatgtttagagcctgaatattgtttaaagtaacaagtaataagaagacaaataccgcttcacacaaaccgtttgaattctgatgcctagctcaaatctgacatatcctagcctccccggaatcaaatttaacactttttttttttgaactagggcccatggcccccatttctcttactagaaatgaagagcaaagtaagaatcaaatttaacacttaacatcaaacatctgtaattgacgatgactatcacaaaggggaaaaaaaattgaagctaccttgttgacagagcaaatgcagaggtactgcgtgttctcgtcctcgtaatggatgtgctccatgagtgcatccaaagctctccccctcagcttgttcatcgcccagctgctcatcaccggctccacccacttgtacagccaactccacaccgcgttctgcagccgcgtcctcgggcagaccagatcctcctgccaccaccaaaatccagagcatgacgaacagttagaggagagagagagacaggggggatggaggaggaacggcgccgccggaaggagggcgagtcgccactgccgccgccgccgccgccaccggcggcgagaatcgccgcctcacgacgggccacgcctcccccaaaaagaagcacaattacgttaggcccaattagaggcccaacaaattcggcccagcctaaaatagtatctctctctctctctaccttggcgcaggcgctgcgggcctgggcccaatcgatggtgaggtagtggaccgggtatatctcctctcgcagtgccaggatggtcggtgtggtggggcccacgaacttcttgccgtacaggtaggccatgggcaggtataccatgcgggtcaggcaccaaaatttgcctgcacccaaattaaaatttattcttaaaaataaatttaatgaattttcttttaaacatacacatacatatcactacatacgtaacaccacgctcacaaaaacgtgaaatacgctctctaacatatgttttaagagacggaaactagtggcacattcatggtctcactaaaatcctgttaaaagtctacctacacatgcgtaataaattaatgaagttttgataaaatataaactctgagcactgccactaaattgttttatattgctactatttgatgtaggaggatatatacatacacaacacagtgtcctattaatatttacctggatgaaagggaaggaactgtggggctagccatagctcagggaagatggggttgtttcctgcccactcgtacactccaagcatctgtagcgaattcaaattaagttgacggaaacgaatcaacaagctacgtgtatttagttagcagcatgcactaattatatatacttcagaatatatgttaaactctgtttgatttttataagagctgcatgttttaatttggaaaggtcgatcttgatgaataacattgttagttatcatcggctgtattatgaatgactataaaaccaattgcgtgaaagtacttaaaaatataaatctttatacgattaatttgtaaatgctaaatatacctatatatcatttagttaaccattatattgctcaaatttatactactatatagcttagcattttgacattaaactgccccaataaaagtaattctttagcaagatttattatatagtgcattttcatgggattatatagtagacagaccgagagccatatctttccccactgtggaacaagggtagcgccaccatgcgatatgatccagatacgtcctctagccaattgctcattggttagaacttcgccgagaagccttagggtgatatagtttgaacatgtgccaaacatggtgctcgagctcaagaacgtgccctatccaccatcctcgttctacacacacatgtagatattgatgtcacaaaatatagaatatccaatgttttctagtaaaagcagatactttgatcaaactttcacaaaactatagatttaaaacggtgtattacaaactacaaatatttttagcattaaatttatcatgtgactattggtttaagattaagtatcataaaaacatagatttaataataaaattatcacaaaactgtaggtttaagggattaaaatcaatactcttgtgatgacaacgttattgaaatctaaagttttatgatatttcactttaaatctatagcttcatgataaatttgatggtcaatatgtagttctatgatacgtcatcttaactctatagttttacaataatttgattaaaatttatgtagtttgtaaaattttcttaatgtttgtttcttcatactagtaacatttaattgttacttacaaaaatatgcttatatatctgaactgtgctttaatttatgcaaaccaccacatttttgtttttatagtggtagcagtacttgtggacagtagagtaatagatgttcttctatacttaataaaatcttaaaccatattggcttattattttagggtcagcccgtatatagtttttttttgtttgtttctttgcctgatggttgtagatatatcgacatatctcctgccgatgctctggtgatatcgtagtgtccagtgatccagtgacatataaagcaaatatctgcatttattttggacagcaattagatcactaaaaccctcgaaaatatgaattaatttagctagagacaatcagacaaatacaattgaatattaattaccaagccaggcatgatgaacataacaccactgaagtcgccaggccagtgtccatcgtctgcttgcaaagaggagaactcgtcgagagctcgcctcaacgaagccatggcgatttcttcagtcacctgttccttctctccaagcttgacggccggtggaatactatcacgacgacgttgaagctttttctgttttgcaaactgcaacaaaatcgaaatgaatgtaacatcgtatgaaatgaaaccaagaaaatcatatcagatgaaagccaacactgtcacgacttcgtattggtgttaattgcaattaattaattagtaacttattaaataaacattcatcttattcgaaaatattttatatatagatataaaagataaattattatttattgataaaacagtttagaaaaaatatatagttattctctatggatagttaaacatacgtataaaacctaactgcatcatatattaaaaaaaggaaaagagtataaccggtcgatcgtcagttagccgatgattgagcggttaagtaacatatatgaacctgcatgcgcatgaggagatccgccgactcgcggcggcggaggcggtcatcggtgaactcacggcgcaccctctcgacgtcggcgcggtcctccggcgtgccgtggtcggggtcgagctcccacaccgcccgcccgaggaagccattcgtcgaccgcagcaacgcgccgccgccctcggccaccttcagcctccacatggtagctagcagctttagctatatgtatatggccgcgaccaccaccagcagctgccagccaatcaacgggtactcgccggagatggagaagaaggtgtagctaacttagctatagactatagagcatgcacacgcgcgtgtgtttggtttgctctttgcctcctggaccaggcctaccgatagtattggcatggctgctggctttttaaagggcttggagccaaatggtgccgcttgggataagctgatgatgtacgcggttgtccttttcatggatattctttctatggagtactaatacataaccccatcatctgtagccggatttctaccaagaaagagttgtattttcttaagccatacgttgattttttttttaataacggaagaaaattatgtcatttactcaacgagctatggcccattattgcatagatccactcaattctgagcacacaccaacaaatccataaaagcacatccaaataacactagataaaactctacatttattgaagcttatttgtaaatctctatccaaagttggcgaaaaattatataaccgttgacttaaggttcgacatgcagcgttcataagtttattgttctcatcacacctttatagttgtgcccaaaatcggagtcaataccttgttttgaaaagtacctgtacataagatttgaatagtgatttatccaaaaccatatcatttctgctaagccgtagagcctaacatatagaatatgctttaacaaggataagatatttggttttataatttattaatacccacaaaccaattcccaaagatataagatacactacatggaggatataaaaaaagaaatttatgctgctctctagagaaatttggtaaaataccaatccagaagtaaatgatagatcatctcatttttcataaaaaacaacaagcaatatgttgatttgacaaaagataaatttttttaagctagtataaatcaggtgtccatttttttaaaaaagatcaggttgtcacatgttgcagtcgaccactaataataaactaagttgtatatgatgaaaaaaaaagttagccgttgaaacatttaaaaatttatgaaacacatgatgaacatgttgctatcgcatttaagacattaaattttaatggttaaaacatactccctccatcccaataaaagtaaatataggactggatgtgacacattatagtacaatgaactggacagggatatgtccagattcattggactaggatgtgtcatatccagtattaggttagttttttgtgggacggagggaatatatctttattttatcaaaataatgtgacatgttgctctaaagatttaattataatgaatataacggtgtgatcggatcttatatccgataagcagtttaagagaaaaaaaaattcgaagatcgctatgaactatgcatcgtggatccaacggtacagcctttcctctcttgcctctttccctccctcgcatatttggtgacggtggcctcgggaggggctacctgatcagccgccgacttcaccgggagctagggtttttgaattttggtaatcttggatttagggaaattttttatttttttttgccaaaagtctattgtaatcatgcgtcttaattcgctcgtctacgaaaaccaatttttattaacgggcatattaaacttgtccatgtatgaaaaatcaattttcacgtacgattacgatgtccgattatgaaaatctttttttttacatatatgctaggctaggtggttgctccacccgcccgtaaaaaaatatattttaccttatctacagtagtgtgcacaccccagtaattataccatgtttggttgcacgcttcataagggattgcgaaaccaaaaccctaatttgaaataaatatataattaaggatgaatagtcctctaaatgacttacctcattttatcctcatcccaccaattaaacttggacacaaaacttagtcctaatcacggcggtcgctttacttgatgccaccaattaaacgtagggataagggcaatacttgcaccgagatgtgctttcaatggtcctgtaaataacacaggaaacgaccgtcatcagctagcaccatattgctggcccaacacacattcatttttaagtacgagatggttactgtgccacaactagcttactctctagtatcttcagccgctttcgtttcacataccatgaatataatgaattaatataatataacagtacctctcaagagtgtgcccttcgaaattgagtgccaaatggcccaaatcaatcagtacaacagtatataaaaatgcaaatcaattgaaagcagcgcagtcagcatgactgaattttttagttgattcaatttgctattcatagttgaattaggctgtgttcgttcacaggagaaaggggagattctgactcgttttccgcgcgcacgcttttcaaactactaaacggtgcgttttttgaaaaaaaattctatagaaaagttgctttaaaaaatcatattaatccatttttgaagtttaaaatagttaatacttaattaatcatgcgctaatggctcacctcgttttacgtatcttcccaatcttctcaatctcctctccctcaaatacagccttagtgttcagcatttatgctcgaacaacaacaactaagctaatctgaattcaaaaaagaactaaactaatcagagagggtaaatggttggattaccaaaatctaaatcttttatcagaattaaaagttaccatcgaatcgatggagatcggtctgaccggagttgatgcgtaggtctgactggacagatacctccgggctgatcgcccgttgcgcagccgtcacctgttgctgctgcagtcggtctgaatgagcagtagacgccactctaaccgccgcacccgagcaaaacacaaatcgaagactcttgaaagtagattaatctttattgcttctatgcgtatttacaaagtgcaagtgaaaaataggggctagggctcatgaataatgttgcttaacataaagtgtttgaacgatttatagctttggtcagatctgtacgttgaagacttgaagtcgtagttcctcatcgtttcacttatacttatacttatatacttatgtttacaaactaaaatttaatttttttaaattttagttttgaacttgattttaaggttttttttcatgatttattttgcaacattttcttttatatcgcttaggagtttgaactataaattaatttttgtttgctaacaaacagtagaaataaacatcaggataagcggaatgatgggatcgatagtatcaaaatgagaaatagttgcaacgtgtcttaaatcttcctatcttcagctagcctacagaactcaattcaatttcttattaaatatactatgaagagatcataagctgaacctattgctgctacatctgaatttcaatttcaatttaaatgctgcaaatattgtgaaacctgaagattccgaagcagattggatttatctagcgcatgctcgctcgattacttcatagctcaaaattttatagatggcgatgggaccgatcatcaatccccatggtgaattcacgtattaggggatgaagatggttaatatctaccatctaagaaaaatctaatggtccaaaacacatcactatcggggatggccggcagggaggccgctccactcccaccctaagtccctatccctcgcggtgacccgcatgcattgtagctagggaccaattatagactttattagtcgttttggctataaaattgaagcccaataaccagatatgtatagcttctaaccctagtcaacgtcaaccctccccttccccacatttctccaatctccacctccaccgcgccgccgccgccgctccagagtccaacgcgcgcgccgccggccgccgcctccccttgcgccgtcgcgcgggctcggtcccgtccccaaccgtcgacgagcgcgcgccgccggccgccgcctcccctcgcgcagtcgcgcgggcgcgctcccgtccccacgaaaccttatctctctctctctctctctctcccacgaacgcgacgacttcgatctcaaccccaccccatggctagcgacgagctccccgtggcggcagcggcaaccgaggaggaggacctcgtggagatcctcgacgaggggtcaggccggctcgacatcgcacggtacgtggaccacgtccgcgacctggcggcgggcgccatcgccacgttcgagggcaccacccgcgacagcttcgaggggaggcgggtggtggagctccggtacgaggcgtacggggccatggcgcggcgccggctcgcggccatcctccgggaggcccgcgccgcccactcgctgcggcggctcgccgtggcgcaccgcctcgggacggtccccgccggcgaggcgagcgtgttcgtggcggcgtccgcggtgcaccgcgccgacgcgatggaggcgtgccgctacgtcatcgacgaggtcaaagcgtccgtgcccatctggaagaaggaggtgtacgacgacggcgaggtctggaaggagaaccgcgagttcctcgaccgcaccaccaccgacggcaccaccgcgtcgtcgccggcgccggcgacgcggccggcgaagggcggcggttgctgcggccgcaaggtgagagtcaacgagagctgatgccaaccgccggatcgcaatcggacggacgtggttttttttatttttttattttaaagagaagagaaggaactacttgtatcatgtgattgtgtaaccggaaattaaattccgtgagaaaataatgaaacacgcaatgtctaaatttaaatttcagaagcaaattccaccaaacgtcataattgtaccatcaactttgccaactgagcacaacaaatcaatggttgcgtagtttatctgcctttatttttgtttttcctaacgaagaagcagagtagctgtcgcattcgcacgggagtcacaaagatgatcacaaatagtagtggctattaattgcttcgtttgatagatttgacaaattttgcgatattcacatatgactcatgtaaattttgctactaatgacagtttaatagtagtgacataactttgtggtatttcacattctttgctgagacaaggccacgtgattgcccaagattcagttgatactttgtgcaagccatcattgctgcatgaataaccctctttttaacacgagaaaattgcaaaaaacacaccagatatcaccttgagtttgagattcctcatatacgactattgttgcaaatacttcctcctaattctgacatttctctccaattagcattattaacgtgctttttttccagtttcagtgttgtacagtaggaattagcgtatttgttgataaacatgtcaataaacacattttcgaagcaatagaatcacatctaactcatctttctcattgaatttgtcaaagataccaaccacctaaccacatgaagcgagcacaaaagctcattttcgacaaccccgatatcagagcaaagactcgatataaaacggagggaatagtaaataagaacccatcatatatattgaattttttttaagcctcaaaagccaatgggttatgaatttacgataaccagtcttgacaatatatatatacaacatcaaattggatcgcaagcaattacatccgagatatgcaacggagctagaagattttgcttgtttttttaggtatagccgagtaatatttgtacagggcgatcaatatatctgcagcatgtataagagtttcctgccatgttctcatgcacgcctctctgagcgaagacgattacaatactctccaagagcccagatgggaaataagttgcggtagttggggtaattgaagaagagggagcaattgaagcatccaacgtgttcctaacatcagtacaggagcacaagcaacacatgagatagatcttaaaatgttcacacaagtaatgctgaatcaccttagaacatccccaggagttaaactaggccatctaattagtttcttttcaagtttccacaatgacagttaaagatggaattgtatgtgttaaaatccttgtacagaaggtactgtatggtatatcagtttgttactacagtaaaaaatatatcgtcgatgtcctgatttttatctaatgtaaagaccatggttctttcctaaaaaccacttgatttgtgcgaggaaggttatagcctatatcattttcagtatgctaattgaattgctagatcatggtttggttcttttctgagcatgtaaacagaactgtattgagcagtataatgtaaagtttagtctagtcatattatgtattaattgatgaccatagatcacatcagagaagctgggggaattaaaccccactcctgacatacgatgcactgtataacatgaactttttttttcttgtgttgttcgtctcattccataaaattacagttgaataacgaactcaagttttccatgaatcgatataagacatatccccaatggaacttaaatgggacttacttgttggggaaactctcctgtttctaactgcatattgattaattcttttgcagcacaatgcagcggggctggatctcgctccatcttacatccaaattaaatagttacagagatcatttgataaacaagttattcctatgagaattaaattgacaataaaaaaaatacctgtccagcataaattaaagtcagcattgcccaagcagtattcactgcatgagcatgatcacctttgatgtttacataaacctgtttgatattataaaaaaaaagcagtggggaaatctgcaaaaggttgacatttccaagaattaccttttaatttaatggtgtattaaacaaaacctcaaaatacgttaaaatttgtagaaatttgcactagtccaacttccctcaaaagatttcttctgaatggaagtagagcttgttgcaaatgaaaagtaataacttcaacatacacaacaaatcaaatgaatgggctgtgattcaaaccctatgctaattcaagaacaaatatttgcttgaatggcttcctttgaggggtatgaacaagcccgcccatgctcaaggcctaaactgagcagggtacacaccattactagggctgtgaggttggttctactataccttcagtatgtcacttctagagaagatttggggataaacaatgctcaattgatctagtcccaaggcaaaatattgtgtacaaggtgatgagaaattaacaaaacacccctaatatccttaacgcagtaaatgccagttctagttgaatttaaagtcgtgctttaaaaaactatgctaattaatcaccattgtgtatcctacatgccaattatcataaaacttccaaccaaatgaactacacaggcttattcaaccataaaaaaaatgaatgatgttgagaaagagagagaaaaaacttaccttagtttcattagagacatgactttctccccatccaccagtattgagctgctttgacattataaaatcacatgctttcctgatggaagaactattctcatatgttcttccagcagcaattaacccttttactgaaaagaaggccccataggtgaagcatacaccccaagtgcctaacctgccaaacaaccaagttattgttagactagaagagagaaaaattatccactggtcagtaaatgctctttctacaaaccatgaaccatcttcgccttgtgtattctcaataaacattgttgcgtttctaacacacttctctatctcttcagtacggtaaccagggcacagttctttgaatagcaccaaagcttgaagcactgaggacgtgcattctggatatctgccaaattaagtacaacgtgagttgcaaggagttactatatctacaaagtgaaatgggtgcttcacggattttctaagcacaatgttacttgcatcacttacggataatcgaccaccatgtttgaaaaactctcacaaggattgagaatctaggttataaaaggagaggacatgtcagggtccgcaatggcaataagaacttgaaataaaacaggtgatttcttcaatgtaaatgtactgaaaatacatgacgtgctaaatcaaatagtaatgttttataatttgaagtgcatgcatgttgctgatgttattttaacatcataaaaaagtttgattgtgctatgagttatgacgtaggcacaatcattgagttcttttctgatgtatgtttataaagcatatcggggcgatagtgtgcagaaactcacctctatccaagtagaagttcttttacattcatatgtagaaacggtaccatctttgttctgcaaggaaaaattaatacgttgagcagatggttttcacatctttaaaccatgacaactaaaactttctgaaggaatctccccggactaatgagactttttttttaaaccgaaggactaatgagactatgagagcacaatcaccatttttagttcgatttttaacattttggccacataaagttggcaacaagttgtgcaagttctgagcttggatttggatttcacagctgcacccatactgagttccagacaaaggttatgtaacatatttaagcccattgtccctgtaagtctggtgcgacagactcctttaacctctcctggttagcacaactgataacagtatacgagatatagtttccacaatatcacgtatgtgggctactctgaaaggaaattacaagatcaggtttgatagctgtatttaaaaaaaatgcataccacaaaagataggaggcaatcgacagcatcatgcagcctttctctttcaatgggatccccaaccacgttaatagatatctttgtcagcaacaatacagcctggaaatgaaattatgtcagatttctacggaagacagcgtagaaattatgcatgagcttattcgatgtgctatcacctattaggactagattaatatgacactagttttatacttcatttgtctacattagtaacaaaaaggaaagaacaaagaaacataatgaccttcagtgcttctgctgtagtgtcagacacagcccatccattgtctgcagatgaaagagtccaagaaccctttgatctatggcgatgccagtaactttggtcaccaggatgattcctaacaaccttcaagaaagaatatgcaatatatgctggattatcttataaagtagttaatttatgatttagattattaaactagagattctgtacctgtgaatttttcaagaactcatgggctctctgaacagtagaagcatactcatttacaagatcagtagcacaaaacgcttgaattataaatgctgtctcccagctctggcaaccatcatatacctatcattgagataacaatctatcacaatttttttccttgaataaatagataattttgtagaacgaaaggcgtgtcatgtttaaagatttagctttattcctaccataccaattgatatttctactgatgtaccccctaattatgcaattgaacatcactggaagtacaataattcataggtctgtcctggttcctccaaatttaatgaaaacactagatagtaataggaaaattttcctagatgtaaaacatttgtcaaagttatggtagtaccgacagtagacgcattaaccatgttacatattcaatttatgcatgaaagacacaaaagttaataacctgtgccttcatgccatcttctgaaagccacaagaaatcaggtactctcgcaagatgctgcttgaatgcgtctgaattgggatcttccgcccagcagcagaccatgtttagagcctgaatgttgttaaaaagaatcaataagaagacagatatcagttgatatatccaaacaatctgaatcctgatatgtctagctcaaatctgacataccctagtccctccagaatcaaactaacagtcagcaccaatgcaccatacatatctaataaacgatatgaccataaagaggaggagaagaataaattgaagctaccttgttgacagagcaaatgcagaggtactgcgtgttctcgtcttcgtagtggatgtgccatgagcctatccaaagctctccccctcagcttgctcatcgcccagctgctcatcaccggctccacccacttatacagccaactccacaccgcattctgcagccgcgtccgcgggcagaccagatcctcctgccatcaccaacacccagagatcattacgaacaattagaggagagatacagggacgatggtggaggaacggcgccgccggaaggaggcgcgtagagccacccgcaccgcgccgtcgccaccgtcgccgccgccgccgtcgcggcctccccactctaccacctcctcgcggggaattttttttatttataattttttttattaaaagttttacaaaaataattttccattttgaaaattgacggaagtagttgcctaccgccctctgggagggcgattttagggcgaaaatgacgtggcagacggccgttcgctctcgggcgacggccgtcaacgaaatttgcaggcggcccccttgccgtcctccgctagggcgattttatactgtgcggggggccgcctgcaaatgggcggcgagggggggcatggaattttgcaggcggcccccttgccgccctccgctagggcgattttgtactgtggggggggccgcctgcaaatgggcggcgagggggcatggaattttgcaggcggcccctttgccgccctgggggagggcgattttatactgtgctctatatttttgtataaatatcaatagttatcaaatctttttatagtgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccatttttgtgtgtggtgtgctagtgggaaagaagatatgaagaggttgccttcagattgtcaattatatagcgtcgttttcactgcaatatatgtgaactcaaagagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatatagacgagacaaacacaagtagtactgcagtagtaatagcaaaagtagtactgctttacaagtttgtaagacaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccctagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgcttgaaggcaaacgaggtcctgcgaggatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagatgcgcatgaccacacgcatcttctcctgcatccggtcgaaggtcaccctctgctcaacgtcagtcaagtgcaaacctctgttcaacctcacttggactgcggtgatatcggcactgatatcccgtgcgtcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcatccggtcgcaaataagcacgtatgataataacaacttatttacttacagtgaactggagcaaccaagccttgctaggcccgactgtagagtacggaggaagggtgttggtcggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctctagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccataccttcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtataacaatagtcggaggtactcattacaacaacattgaattgaaattacacgatagaagtatttagtccgaacactcattacatcacaacagcattttatttcctaaatcgaaagctttgttacaccatggaatcgcctgctgcgcgacgacaccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactatgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctaccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcacattcaactagtggtctgcgagattgctcatctgtttgcttcgttgtcaactcatccaacttgtcccacaactaattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacattgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcatactctttgttcgatcatcaaccgatgtaaatgtatgtaggtcatagtacgtatcattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagacaatgttaccaacaacactgctgtacatctcacttgccacaaaagctgaagtgatatttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgtctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgttcctcccttcgttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgtgttaacctcgcatttctgtactacgccctaagttacattctctacaatattgttctctaaatttctaaaattacgttacattcttcagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggggaggcaaaaatcgccctcccctagggcggcaagggggccgcctgcaaaattccatgccccctcgccgcccatttgcaggcggccccctccacagtacaaaatcgccctagcggagggcggcaagggggccgcctgcaaaattccatgccccccctcgccgcccatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactacattcgtcaattttcaaaatggaaaattatttttgtaaaacttttaataaaaaaaattataaataaaaaaaattctcctcgcggggcactcctcccccaacaagaagcccaacaaattcggcccggcccaaaaattaccttggcgcaggcgctgcgggcctgggcccaatcgattgtgaggtagtgggccgagtaaatctcctctcgcagcgccaggatggtcggcgcggtggggcccacgaacttcttgccgtataggtaggccatcggcaggtataccatgcgagttaagcaccagaatttgcctgcacaaaagtaaattcagttcaaaattaaagaattttcatgaaccttaagtctgatataaactccaggcattgccattaaactgtttttgatttgtgtgcaactagctactatttgatgtaggagtatacagtatgattattactagtatatatatacctggatgaaaaggaagaaattgtggggtcagccatagctcagggaagatggggttgtttcctgcccactcgtacactccaagtatctgtagtgaatcaaattaatttgtccgaaatcaatcaacgcgttatattataagtcgtttgatttttttcataattaaactttgtcaagttggcccaaatttatagaaaaatttaacaacatctaaaatatcaaattagtttcattaaatataacattgaatatattctgataatatgtttgttttgtgttgaaaatactactaaatttttatataaaattggtcaaacttaaagaagtttgactagaaaaaagtcatatggcttatctatacctaataagaaaaataagtaaggtttcctgttctctttccgtccgtttttttcttttttcgctgttttttcttttttatacctatatatataataattaaggtttccggttctctttttgtccttttttcttttttcgctgttattttcttttttccatcttttttcttttcctccgtccctttttttttcgggcttaggtttttttccgccgtttttcttttcttatttcgttttttctcctttctttttgccttttgggctttttttttctaccttccctctaatcagggttcaaaatttcggaacgaaatttacgaaatttcgggtctattggtgggtcctgataaacatgagctccggtcaaaaatttcggcaaaacaatgttcatggtaaaaatcctcaatttcctatcccctcctcacttatataccaaaggctgctgctgcttcgctatcctccgacagctcgcccagcaggcagcaggtcgccatcctcccaagctagcgaacagcggccgcggcggtggccggaaccggaggcggcgggttggttggagtggccggcggcgtctccgtggctcttcggcaccacgacgacgatacaagccgcgggcctcgcatcctccgtttggctagagttgccgctggcggctccatcgctcttcggcagcacgacgatgaccggacgacgacacaagccgcacaagcctcgcatccttacgtgttactgtgtttcaatctcctgttcctctgctttggattgaatagactcgatgctcatctatactctgatcttggtaaaatttctttatttttattgtttaaattcaaattttgtttgaaaattccgttcgaaatttctgaaagattttcgaaatttcggtgacccctgaaatttttccccttcccgatagattgaaccctgcctccaattcttacccaggcaaatgattatctcggttgaaattttcgatttttctaacttttttgtgaatttagtcaaattcagttaaattgtgttaaaatttcaaaaaatggtctaaaaaacgccgaaaatcccaaaaatccagaaatttcgtttctaccaaaatggccgaaatttttggcgcgaaagtgaaaaccttgtactataaaaccaatcgtgtgaaagtactttaattaaaatatgaatcggttggtacgattagaaagtgctaaatatacctatcatttagttaaccattatattagtcatgtttatataaatcaagatgtttcgaaagtaaactgaaccctacaaaaatcaacgaaagcaattgtttagcaaaattcattattgtgtggattcatgcgataatatagtagacagaccgagagccatatctttccccattgtggaacaaaggtagtgccgccatgcaatatgatccatatgcgccctttggctaattgctcattgcttgtctcttcaccgagaagcctaagggtgatatagtttgaacatgtgccaaacatggtgctcgagctcaacatcaaactgccccatccaccatcctcgttctatataacacatgcatgtgcagaatttgcagtcacaaaatatggaaaatcaaatgtttttaaagtgaatttcacaaaattacatattctctaaccaagctattataaaattatatatttaaaatggtgtatcataaaactatagaattaatattaaatttatcgcggaattgcagatttaagagcgagtatcataatattatagatttaataataaagttatcacaaaattataggtttagcaccaaattcatcataacttattactctaatataataatatatagttcgagtaatttaaataaaacctatagtcttgtgacaaaaacattattagatatgtacttttgcaatattttaatgataattttgatggtaaatttgtgttttgtgatacgttatcttaaatctatagttttgacacagtttggttaagttatatgtagttttgggaaatttactcagtgttttttatactaatgacatttaattgttacttagaaaaatatgcttatattttgtctgagcaaataagtctgaactcgtgctttaatttatgcaaaccacccatttttgtttttataaacattcgtactgcaagtactggagtaacacacgttcttctataattaaaattattaaaccatgaatacatgagcatattataattattttatggtcagtcgtccatatatacggaaaaaaatatgcctgatggttatagatatagcgacatatctcccgccgatgctctggtgatatgatagtgtccagtgatccagtgacatataaggcaaatatctgcatttatttgtacagaaattagctagatcaccagaaattaaaccacgaaatagctaagcataaattatttagccagagacagatacaatttaaatatactaccaagccaggcatgatgaacataacaccactgaagtctccaggccagtgtccgtcgtctgcttgcagagaagagaactcgtcgagagctcgtctcaacgaagccatggcgatttcttcagtcacctcctccttctctccaagcttattattgacgggtggaatacgataacgacgacgttgatgcttgttttgctatgcaaattgcaacacaaaaggaaatgaaaataacaccgtatgaaatgaacgaaaccctgcaacaaaatcaaatgaaagcgaacacaccgtacagtttcatattggggtaaattgcgtttctcaaaaagtattggagtaaattgcagtttaactaataagtaattattatataatatatacaaataagagatatagaaccattcgtgtttattactcccttttttctttaatatatgaggtggttattgattttcgaaagatacagagccattcgtgtttattacttcctttgttctttaatatatgagattattgatttttaaacatatatttgaccgttcataatgctttctctctctatatataagtcgttcttaatgtactgcagtgatgatataaccataaccaaaatagaagtatataacaactgaatacttttattaataaacgaatagcgacattatatatttaaaaaactaagggatgaatgagcgtatgtaattaatatatacttgcatgcgcatgaggaggtcagctgactcccggtggtgaaggcggtggtcggtgaactcacggcgcaccctctcgacgtcggcgcggtcctccggcgtgccgtggtcggggtcgaactcccacaccgctcgcccaaggaagccattcgtcgaccgcagcaacggcgtgccaccgctctccgcaaccttcaacctccacatggccgccgccagtcagtcagccaatcaactcgccggagatggagaagaatggccacctaactagctccagctagctagagcacaggttttggattaatttgctcctaggcaaggcatagcaatacctagctactcacatatggctggcttttaaaggggaggaccttggcgccaaatgatgccacgtgggataactaccattcgcagtgtgtcccactgtaatgctgtgatgaaataagttaatttgtacgagatttgatattttctagcactacgtacgaatctgtacagacgtcgtagtgctagaaaatgtcacatcttatattagattaacttattttaggatggcgtaggagtccatgtcataaaattgtaaaacccgatttgacaaaagtttgcttactgttcatatttattttaagaaaaagaggcaggacagaacgagtagatttttttctatcaaattaatcatgcgaattatctgcggtccaatctgcctgtcgactgaaattataagtaaattttctgtcaaatctgatagggaagtttatcttctattgttttgtccacgcaacatattatagctattttaaacttgtgcatgtgtgtcatttagatccccaaactctcaaaatgcattttcggatctctaaacttgtcttggatgtcatataggtccaaacgagctacaacccactctatgcgttgatgtggcatgccacgatagtgcctacgtattagttggacccacgtgccaatcacatagaaaaataaaattaaaaaaacatattttctcctctctactttagatttttttctatctaccttatatgagaaaattatggtttttaattatatggattccacttacacgtaggcaccaccgtgacaataccacgtcaggacatggagtgggttagaactcgtttggacctatataacacccatgataagttcaaatatctaaaaatgcattttaggagtttagggacttagatgacacacccgcataagtttagggaccgcccatatacttcactcctaaataaaatctcaatcgtctcactctcacatgcatcacgctctgattgtgttgtgaaatctaactattcaagtataaagataaaaatcagttttcctcaaaaagaaaatgaaaatccagagcgataagcttttactagatttttaaattacagtatcagaacatacacatgtagaaaatgaaaagaggtgcaaaacaaaggagtcaaatacacggcaagaacaaataaaagggtgtatggaacaaagtagccatgaaacttataaaacaaattacagtgtgcaatatatatctagatatatatagacgcaaagagaatcattgcagcggaattattcatgtaaaattcttcatgcccttaccctagctatttaatttgggaaaaagtacgaattacctcccgaactatcacgatcgactgaattacccccctgaaccacaaaaccggacattcttcactcataactatgtaaaccggacgaattacccccctcgacctaatccacggtgattttggtctacgtggtgtacgtgtaacagtacagtcagctttctatttataaaaaagtagtggggtccacctgtcatatcttctcatctcactctccgtctctctcactcatcctcccccaagcacgcgggtcgagcggcagcggcggcgcgcacggcgggcggcggcgtgggacggcgcggacggtcggcgcgcgagggccggcgacgggcggcgtcgaggtggcggccgcgcgggcgcaggtcgagcggcgcgggggtcggcgcgcgagggccggcgacgggcggcgcgaggtggcggccgcgcggtcccaggtcgagcggcgcgggggtcggcgcgcgagggccggcgacgggcggcgtcgaggtggcggccgtgcggcgcttgcggtcggcgcgcgagggcaggcgatgggcggcgtcgaggtgctcggcgatgacctcctccgcctcccttcccccgctgcgctggtgcgtgccacgctcgcggacaggtccttccgcgctcgccaccacacgctgccgatcttcctctctgccgccttcgactccggcctcgttcctcacctgcagcggctgggccttcgcctcgttcctcccaaggcgccgcgaagaagctcgcagtcgccgaccccgcacacctcccgtccccgcgacgttgccatcctcccatccccgcgccgccgcccaccatgagctccggctgcctcctccgcgggcggccaaagggaagaagagggcggcggcggctggatttaggggaaccagctcgcctccgtccccagccgcgcgagcgagctccgccgctggccgtccgagtacgcgcacgagagagagagcgcaatgggctgggagaagctggatgacaggtgggcccaagggattttttttttctgattaggctgccacgttgatgccacatgtgatagctgaaatcaaaaccgccccgaacagggttcagggattgtttgtccggtatatatagtttagggtgtaaaatgtccggtatttaaatttagggaataattcggtcgaccatgatagttcaggggatatttcatacttttttctttaattgtggtcttacaattattagtactggcacataaaatatactggcgataagggctatgtatacgtactggcgtatgtatatctgcgggcgtgtgtgttttatgtgattgtaaggaaaatcgatcataaaaacttataaatttctaagtaaaagaatgaaattaacctaaaacataatttgtctttttactttggaattatacaatgcaatcaattcctccacttagggcccctttgatttgtaggaaaatgtagaaattttggaggatttcaatcctatagaaaaaaaatcctatgaaagctttgaaacaaaggattgaattctatccaatcctttaaaattcctatgaaatgggtaatcctatgcatatattggaggaaagttagcaagaggtataacctcttggaacatttcctctgagtctatctttctcatctgattcctgcgtttttcctgtagtccaaaataatggccattctggtatttttcctgtgttttacagttctctgttttacaattgtattcctgtcagaatcctgtgtttttcctatttctctgtttttttattcctatgattttaaatgggcccttaattttttctttttttttctcaactatgagaaggggttcagatatggaaaggaaaaaggttgaattgaacaagtgatgggactgacatgctctctgtagcgcctagcggcagtgaaaacatatgagaataatctgagaattaagcgaagcatgcacgcctaacatgctagcttggggtggtgtttgaatctcctgaagataaaaatgaagattaagtatttcacgcaaaatgagatggtagtaacgtgtgttaattaagttttaattattacaagtttgaaaaatagattaatctgatattttagggcaactttcatatagaaagttttcgcacgaaacacatcgtttagcagtttgaaaagcgtgccacgagtatccaaaatttaatccaactcttctgggagaatccaacgcagcctttacactgtatgatttgcagacccgaaacctgaagattattttacactagcctcggctagctagaataaatcaaacgtcaagaattccatgaattttgagactttcggtataaatatggaacaacccacttacatatacagcgaggacattaatcttttaagccacaactcttataaccgtgtttactcgtggagcttttctacaccatattagtaattttatcagaatggctacccttctgtcgatagaaaatctattcccaaatcttacagattttgattcactagatgtgcttttcgattcatgctctagatgttttttctccaactctgacatcctccttttcttcttcaatgccggtgacaacccaaactctagcgaagagccaataaatgagggtcccgggttagagtggggatgggaggggtggaaggggaagggagaagaagggggaggttgccgggcttagagggatggttgtggaaggtggaggcgtcggtgccggttggtagcagtggaatagctagcttgtggttaggaggtggtggctgatccaacagcgaggagccaccagagacaaggaagatggcggggtaggggcatctcgctaccgatggctccagaagggaggagaggagggggggggggacgcgtgagagctaagcagcgactgtatcgtgagaaaggggatgaggaggaggttttgtgggtttctgtcgtgagaaaggggatgaggaggaggttttgtgggttttaatttgttgctctggcgcaaatcttaatgcaattgggtggtctaaactttgcaggatttatagaaggattttctatcaaatgatgtatagacaacctataattttatatactgtagtgtgttatatctcatataatctaacatgtgtgaccctttgtcagataatatttagtgttttttttttggttcttctagacgaggagggtaatagggcatcacggctagcagatggcaagattcgcctgcctttgccattagcaactataaaaagagatccgccacacttaatagtttctaatatgcatcagcatccatataattaaacggatagatacatgtgcacccgtaaaccgtccatgtcggttgcatgcttcataaagataatgaaacaaataaaataaaataaaacggagatatatataatgaaggaggaattaatagtccttaatgtgggatgcattaattgcattacctaattttatcaacgtcacctattaaacttagacataaaatgatgatgatgatgatgatgatgatgatgatgatgatatgttcaccaattaaacttagacacaaaacaatgatgatgataatgtgtttttaagagtactgcgcaactgccatttcgtcctcgtctcaccaattaaacttagacacaaaacaatgatgatgatgtgtttttaagagtactgcgcaactaccatttcatcctcgtctcaccaattaaacttacacacaaaacaatgtttattactccctctagatttaataatacttgtcgttttaaataacgatacggtctttaaaagataactttgaccactattttttatgagtaaattacactagcggtccttaaacttgtagcgaggtttcatttagatccatgaacttgcaaaacgagtattgagatccctaaacttggtttaatgtatcatcccggtccaaagccccatttgactgtggtcttgcctacgtggcatgccacgtgggcgatgacagggatttttttttattttttctcccttctaccactggcccacctgtcagtgggcttctctgacctcactttccctcttctctctatcctctctctctctccgtgcggttgagcaggacgtatgggcagccagcaaccgaagcggcgacgggcggggcggccggcaagaaaggagcggcgcgcgggtgccggccggcgggaggagaggagcggcacgcgtgcacgggctgcggttggagaggagaggagcagcgcgcgtgcacggacggcggtcggcgagaaaggagaggcgtgcgggtgaggccgacgggaggacgcgcatgcacgggcagcggccggagaggagaggagcagcacgcgtgtgggggaggcgtcgctgaccacacccgggaggagaggtcgccgaccgtggccacgtgtgcgagggaggcgtcggccatagagcgcgcgagctcggtggcggagatgaagtcgttgccgccgccggcctccccgccccctcaccagcctcgcctggcactgtttttttccaccgacctgctccgccagtcggccggccgccccgctccgacccgcttgtcgcctacttcggtcgccggccgcccgtcccgcttaaccggccgaagagagagaggatagagaggaggggaaagtgaggtcagagagaagaggagagtagtgaggagagaagtgggccccacctgtcagtgtcaaaagggagaaaaaaagaagaagggagaaaaaataaaaaaaatccatgtcatcgtccacgtggcatgccacgtaagcaagaccacggtcaaatgaggttttggaccgggatgatacattaaaccaagtttagagatctcgatgctcgttttgcaagttcgtggacttaagtgaaacctcgttacaagtttaagcacctctagtgtaatttactcattttttattataatatgaatagaagtgttaagaaatatatgattttattgaagtactttttaaaactaatctatccatatagtctccatatttcaaacataaatattttagaaattattcataatcaaagattttaaagtttgaccttactcttatccaaaacgacaaatattatcagcccggagagagtagttgatgatgatgatactccccccatcccaaaaataacgcagttttggatttttcatgtagtacaacgtttgactatctgtcttattatgaaaaaattaaaaaaaatagtcacatataaaatactatttatgttttatcatctaataacaataaaaataactaatcataatgcattaccatcaagtgtgggcccttccaaaatgagtgccaaatggcccaaatctattagtataggaacgctcaatattcgttcaaaaagaatgtgaataaagcaaatcaattgaaagcggtcagcatgtactgaattttcagtaacggaatcagctggtagctgttgttatttatgcacttaattaactgtaaacccccacatatttattggtcttgcaatagtgatgattgtgattctgcaaataagtccaccacatttgcttttacatgttttataaattagtcccaatattttttaacattatacaatagtttaatatttgaataacatatactatttaataagcgtggccattttatctatatcaaatgacaagcatttggctactaagaaaaatcctttttgtaccaacaactagagatgacaataggaacccgttattcgacaccgatgagattatactctaacagaaactaattatgttttacatctatggatctgtcgacaggcgaggttgtttggttatccatatacttcctccggtttcattttaattgacgctttggacaataacacgctctagtttctaattttatgtttttctagtttctttaaactaaatatttttaaatatttttaaagttattgatggtcaaagttataaaagtttaactttaaccttgttcaaaacgtcaattaatatagaagtagagggagtacctctatcatcactagcatgctgtctcgctgctgctgatgcatgcacaggacaataacgtcattgtggtgaactacaaggcggcaaattggagcgtaaaaagatttgaaaatatacgttatttttgaactttttgcaattatgcacgtgtttttgaaagatttatggaaatatacacataccacggggcaggtgcgtgcgaccgattcattggcgcgacgcagacgcgcatgcacaagattgatggccaggataatcctacgctgcgacacagcgccaccgcgcaaaattcatctccaaaaatttgaattcaaaaaaatcagtggtttcgcagttaccgcacggtttggaaggataatcgtgatattcgtgcagttatcgccggatgtgtgtagaaattggggataattggaagaatatataggatacttccaagtataacttttgggtgtaaaatacaaaaaatcggcatgatctttctttattgtggatattgaagcaactcaacggtcctgtttgggggagcttgtcccagctgcagcttttcccaaaagctgcttctgctagaaactgtcccaaacagtccacagcttctaagaatctgtagttacagattctgaaaaatgaactaagaagccagaagctggagaagctgggtttcagagcttttccagattttcagaagctggctaccaaacagctgaaacattttatagcacaataattcaacaacaacaattcaacgacctcatatttcaaagcattatgaagtccacataaagctgaaataatacagtccacaatatattatccacgactacaaatatgattgttcataggataagcaagcatcaagaatatagaaagttgtagttcgaaacgaatgatataaaaaaggacaccggatgcactgaattcactactgcttaattaccaatatttccaacagtcttttcaaacagaagtactcaacaacttaccaaactaaatcttccacaacattcaacatttgcactacataatttcattcaacattccacatttgcacttactatacccgaaccctagaaacattcaacattgaactaaagacacaacattcaactatgtaaaccacggtttccacgcgataactgctataggaaccacggttaccgtgcaatttgggacgattatcaccacttccttgcataaaacacagatccactgccagcggtaaccgcgaggaggatgagggttacctcgaggcacttctcctaggcgataacctcctccctagttgcggttacctcagaaaccgcgcgattttcatgctcgccggctcgtatgcggcggattaggcgccgctgctgcctccctcaccctgtgccaagtctgccaacagagaaaggggggcgcctagttggcgcgtgtgcgcccccgatgcacgttttccgggaataattaactatttgccacttacgagtggtgcaattaattatttgccactggacccacatatcatagacacatgagggcccacatgtcatagacagcgagtggcgaataattaattgccacatcttaaaagtggcatggagttagatgtccccgttttccgggactaaaaggtagttaactattcaattagttttagataattacagtttgagataatgacggtagtagttaggatttttttaaactaacaaattgaaaagaaatctatatctgaagtcaaattttcaaaattttaaatctagatttgaaaattttcactcgaaatttgaatttttaagtcaaattttgaaaactttcaacttttcatctcaaatttgaaaaacattcaactcaactttgaaactttcaacccagatttaaaaactttcagtccagatttgaaaactttcaactcatattttaaaacttttcaactcgagatttgaaaactttcaaatcgagatttgaaaactttaaatcgagagttgaaaactttcaaatcaaatttgaaaaattttaagtcgagatttaaaatctttcaacttagatttaaaaactttcaattcggatttgaaaacattctactcagaatttgaaactttcaactcgaatttgaaaactttcatctcaaaattaaaaacatttatcttacatttaaaaatattcaaactaaaaatttaaaacttctaactacaattttgaaaacttttgactccaaatttgagttgaatcatgcgcttagattaaaagaagttcatgaaaaaaatcacaaaaaaaatatccggaaaagaggaaatcatgcgtatatggaaaaaatcgaaaaaaaaacctaaaagtcgcatgtgggcatgtgtgggcaacgtgcgcgagataaccaactgacgcgtctgcgcgaattagtttttctgcggaggaagagcgtgaggagagcccccaacaacccaggagatattttcttctcttatgagccttaatgcgctatctgtaacagtgccaaacaaggcccattccatttcttttcattttctaattgacttttggttttgccctcaaatttgaatttatcttattctttttcaaaaaaaattcttcaccatctgccactacaaaccaagaactacttccatgaatttttttcaatttttttcagaattttgaatttggacaaatttcatcaaaccctatcaccggtaacccctatggtatacccccccccccccacggttaggacgataaccgcagtaaccacgtggttaccggcgataagggaaaccgtgagttagacataagcagttgggtttttctataacagaagaaatatgccatcaagtgatcattaactgggtcatttcaaaaatcattaaattagattgtagttggtaatttggtatgctcccccggtagcccacaatgttaaggttaaatttgatggtgccattaaaaaagggttaattggatccatgccactgcaaatatgccaattaaaaaatgccactaatattcagaatatcggctacatatgccactgaaaattggagaaattggaaccgtgccactccatcacattttccgtcaaaaatccctgttagcccccaactgcacgtgggccccacctccctcccctctcttctctttccttttcctctctctccaccaccatagatgcagtaggaggtgtcgtcgccgtcgtcgtctcagagatgggggtcgggccgggctgcgcctgcgtcgtcgtcgtcgtcaagcgcttcatctcgaagccgggctgcactttgtcgtcgttgtcgagcgcctcgtctcggagtcggcgggccgggctgcgcctgcgttgtcatcatctactcccccggcgagggccccggccactgcccatgtgccgattgccaccccgtccaccgccatgtcgccgtccccaaccctcgccgctgccgtcaccgatctccttcccccgtgccgctcgtcctgccgggcttcgccctcggctccccggtcgccgattcccctcagcggtcgtcctcctgggctcaccgtcgtccatgccggagaagcttcctggccgctgattcccttgacgacggcagcgagggtgccacgtccgccggcggggacgatgaggaatggacaggtcgcggcggctgttggcggagaagtagcgagagatagagaggggacccctgactagctgcagtaggcagtggcaaggaccagcgagtctgaggtggagtgctcaccggtgtctatggcggagaagcgaagaaaagaagaaggagacagataacggcggttgacataaaactggacggaagtgacatgattccaatttccctaaatttcagtggcacgtagccgatatcgcgaatagtagtagtattttttcgaattggcatatttacagtggcatggatccaattaacccttaaaaaattaccattttagataaatgcatttaataatcatctattcgtaatcatgttacaggtattcttgtcaaatctgattcgtgccatttgtggtcgtcgtcgtctggcggcattgacatattttttttttcgcgaacgctcaaaaaaatcgcacgttaatatattagaagaagatagcagagtttagttacacaacaaacattcagaaggccgttgccaggggccaagaggaaaaaaagaaaaaaaaacaaatacggaaacggttagctactgaaaaagagaactcccggcggcattgacatattttcatcgatccgtctttttgtttggacgcaaatgtcccctcaagctacactaaaaccgaccttaaagagcaggatgttactatggatttgaagttgatcgaatcactctacactgacgtaaacccatggtggtcgctagtcgctattactccttaggtcatgtttagctaatgattaggaaaataattttccacccaccaaagagtttcttcaaatcctagccatccattatccctccctcatttcatcctagccttcatccatttccctatctcaatcccactactcttatcccattatccaaacacacccttaatgtttcttcattttttttaaccttctcctaaattttttttaacccgttgattttcttcattttattttctgcttaaccttttgtatttttttactagcaactgaacccgaaccaaagaatatttcttcatacatcaatatgaccattttctttatctatctaaagagaatcaagatattagaacctgaacttgttgcttctaccactgaattttggaataattaatgttttgccactctggatgggtagtgtcaatagatttgccgttttgtgagagatgcgattgtgagagggattaaactgatctattaaaaagtgttaaaatgttaaatcccctgaatttcaatttcaatgctgcaaatcttgttgaacctgacgatccggaactctgaactgtctaaagaaagtcacgtgggccgtgtttagttgcaaatttttttttcaaacttccaacttttccatcacatccaaactttcatacacacacaaacatccaatttttccgtcacatcgttccaatttcaaccaaacttttaattttggcgtgaattaaacacacccgtggttggcatctacggtaggagatctgattttatatgacacatgtctgtcgcgattgctctgggccggacgcccgattcgggtaaaaatatatcgggcaccctcacacccttccgttgtccccttagcctctagtgttaagccaatagcttctctctcctctcttctaggtacacatatagccacctctttaataaactataaactatattttctcttaaattgcttatctgattaaaatttgattgtaccattgaattagttgcaattaaatctttaaactagaccacacataataatattctgataaaataacatttagcaagtttatgggcaaagctaaatttatagcataagtagtattttaatagaggtgtttggtttgtagcaatcgaaactggcccagtaatacgaattggctctgcatttctgcaataatgatgtgtttagctgatcaagctggctatgtgtagaaaccaagtgctagtactagttagtggccttgatgttgggatcgatcgatgtctatggcaactagcaatcataaagtcctgatttagagagagatcgatgtagtggttttcatttctagtttaatgtttggttgttcattgtcctattcagcctaacatgtaggcctgttattccttttaaatttttgggtccatgagcaccacggaccaaaccgctattaaaacagacgagggacttaatttgctccggttttttaagacggaggagatgttacaccggtattgcggttaagggagaggcgattaaatcaagggatacaagttgagagacacaaaatagacttatccacagatataatacggcccgaattctcgcttgggcgtgcagcgggtaggcccatgagaaccaaagcccaatatcggccgttcactctgggccacggcccatgcccgacggccgacgtgtctcgccgtccgtcggccacgcggcggccgccgagacgcttccaggatactacacgtctctgcacacgcgtcagcaagctcctgtgcttgcaccgtctacttatctcaattctcaagctctcagctatggagtaaactatacttgcatcttgggtatttttttcagagcaaatcgagatcgatccgacagaagcgagcgatcatggggcacggcaaggaggtgaagacgaggccggatcccaaggtggagatccaggttaggtttgctgcttaatttaattaatttctccccatttgatcgcattttgtatttcttttttacagtttagttcagatcagtgttagcttagcttgcggagtggattaatggcgatcgatgtggtgggatgggatgcaggagaagggcgagatcttcttcttctatcgtcccaaggtcggcaaggacgaggcgcgcggccccgacgacgtgcagcggatgtacatcgtcctccgccccgaggccaccggcgacggcggcgaccgcgccgtcgaggacaagcaggcgccggactccggcaaggagggccacaagaatcagcagccgcagaacagcgacggcgatggcggcggcgaaggcggacacggcaaggaggtcgtctcggtgacagagagttgcagatttttcagagattttcaggttaaatttgatggatgccggtgttgttgcattgcaggaggtgaacgtcgaggagcaggcgctgctccggctgatcgtgatggggaagaagagcctgccggacccggcggcgaagcgcggccgcccgtactggggttacgtcgagctcgtcaccaccgacgtcgaacacatcaaagacgcgctcaaggaaggtacaaaacgcattcaaattttaatttcgttgttccaaatcgaaatgtgaacttcttatgtatgaatttgttgcgatcgattttgcagaggagtacagcacggcgacgcgcgggacgcggcggagggcggcggcgagggcgctgggggagggcgtgtaccgcatcctgaagcacgactccgggcgccgcgttcacacccacctcgtctacaagctcgagctccccttgccggcgcgtcgccgcgagcacgacgccgaagccgacgaggccggcgagccgcaggaggccatgaacgtggagccggaggcgtcctacctcatccagatcaagaaccccgagcagccgccaccctccggcggcgggggcgacggcgggttccgcgggctgcagagcaagcgcagggcggcgttcccggcgcacctgcaggggcggttcgggagcaaccaccgttacgcgccggccgacccgccggacctgctcaactacgaagggtgcgagttcctgctgatcgccgcgtccgacgacgtcgaggaggagctggggctcgagctggagaccgagaccgacgccgaggccgacctcgaaggtgatggcgccgccgccgccaagtgctcggacctggtgaagatgttcggcgaggtcgccgacgtgaagccgctgctgtccgggagttgggactagagacaatatgcacaagtgatcagctcgacagatagtgtcagtgtgcatagaatgtagaactagtttcagtgttcagtgggcttttggtgcaattagtagacgagtttaggagatgtttagagttctagttttagtgctgtactaatcttttggccggtgagtttggatggtgattttggagaacaatccgaaaatccaaaaaaaaggctgtaactatatttatgtcaagaacaagatcagtagcagcttctgagtatcttctgagtatctgtatctgtctggtttcgggctggtttgctttgttgtttgctttgaggcgtaaattggtcttagtgtttagtgtctatttgtatattatcttcataatatatgtagtgtttagagtgtctatttgtatattactaccttcatgatatatgacgtccttcataatatatggcgttattgacttttttttcaacgtttgatcattcgtattattaaaagaattatgtaattattatttataatatatgacgttattgacttttttttcaacatttgatcattcgttttattaaaagaattatataattattatttattttattgtgacttgattcatcatatgttctttaaaaaaattatgtaattattatttatgtaattattatttattttattgtgacttgattcaccatcaaatgttctttaagcatgacataaatattttcatatttacaagaaaaatttgaataaaacgaatggtcaaatatttttaacacattaatatgaagggagtagtaatttaaatagtgtttagtgcctatttggttttggtttgaagtcaattttggcatgcctaaaaaataggccatttcaatagttaacgtagactattttagtttcaattcaaatacaactttgtcttactaaaattagccatgtcaaaatttgtcaaaatttggtagtttcaatagtgtttagtgtctttggtttgaagccaaattttggcatgcttaagaaatatgccattttaaaagttaacttagactattttggcttcaattcaaatacaattgtcttactaaaattagctataaacttgtcagaatttagcattgataaaaattggtaaggccaatttatgtcacaaaccaaatcaaccctcttcaagtttcatgactcattgtttctctatgttctgtatgatgatgtagggcttgtttggtttgataccaatttattaccctactaaaatttttactaactttaatagtagcaagtgcatgtttgatttgttaccaaatttacccataatagttcaaattcaatactacctaatttgatagtgccaaaactaactttgatagtacaaaaattgattccaaactaaataagcccgtaacctctaaccatatactccctccatccattaaaaatatcaacatagtactggatatgacacatcctgaatatatgttcatgaatatattttgattcgttgtactagaagtaggttggctataggctcatttggtttagggtctattagattgctaaaaaatatgctctatcaatatattggtaatttgaatggtaattgtgtttgatttgttcattactaatacataatttagatttggcatcatctagaacattcttcactgtaatttcacattttgactatattttgttggtagcaaaccaaatatgatcaaatacaatcttactttaccaaagattaggtagtgccaaaacttacatatattttagcactaccagaaaaattgataggataacaatccaaataggcttttagtatcctaccaaaattttggtagtgccataggcaagttttggcactaccaaggttttggtagggtaacatagtacatatgaaagtttggattaatgccaataaggtgtcaaatttttgtgggtcaatttccatttggattggtaccaatgaagcgctaccaatttttttggtagtaatagctttgttactatttgttgcagaataagcacaaataagatgataagaaatatgcataattaggttcattttgctcatcatggtaattatatagcgtaaataattacaatggtagttgtgtggggttacttctaggcacttccggccgatgacaatatcaatttgaatttagccgttgctaccaatttaaatttaggcactaccattgattagatcacaatccaaactagccagtttactattccaataaccaaaatattggtatgtctcagttttggtagcaaatcaaaacggccctatttgtttatatgtttatgaatatattcagatccgctatactagaagtaggttggcttctttcgggacgaagtacgtgtctatatatcatcacagataaatagtcacgagccattgaaaataaaattagagaaaatagttatgagccatcaaaaaattgggaagtcggatactggtcgggtactccatgttagcgggtaaatgctgtgaaatataccgtgcacttcacgtggcttcctacataacaaaaacgaaaaaaaagaaagaaaataacgaatcaaaccaatccaatgcttcgtgtttgctgaattcttgtacagttaggataatgtatatgtcactcatgtcactagcatatatttgttttgaaagtgcaggacaattcaagtgatagttgtccgagcagccaaagagagaagacgatttctatcaacttaatatctatcattcacttatgctttcataataaaaacatcttattgacaaaataaatataaaaagctagtggcacaccaatttacgtgcgtgagacggaacatatttaataatatgtgtctgtattaataaatctcaaataaagtaatcacatattattttagttatatttgataatacgtagtaatatctaaaaaaatgtatataaattttttaagcacacgcacagtgtaagggatgaaatagaatacatgtttattttaacaaaatttgcatgttaattaggtttttccttcataatttagattttttttgtagtttttttaaaatctagtctaattttcataattataatccacgtaattaatatgttttaaattttcactcacaatatgttaaagaatgaaagaaaatacaatgataatatcagttgttttgaggacatattatgttagagttaaaagtattttatattaaggattagatgtatgaaaattcaaataatttgaggtaattaaaagatattcgatgtatgcttaaaaaatatatggtttttaaaattaaaccccaaataatcttttattagaatcaaatacttaaaagatattcgatgtatgctaaaaatatatagttttttaaattaagccctaaataatcttgtattagaatcatatattttaaacttcctataatattactcttgaaactctaacaacaatcctaatttcgttaaaactcttcgatcataagcctcaaagcttagattagaggtacattttgagatatcaaatattttacaaatcctaaccaatatacattatttttctttgtatgaaccaatgttaggtgatgatgaacacaccgcccataccttatcatcccacatcttatatatacccaacacttaataaataaaaaaattattacaagtctttctaaaaaggacttaaaaacagaaaaacaaatatcagcgattctttctgaaatctcagctcgttttttttataacacttcctatgcacgggttacatttcgtcatgtgtcactcatctgatgggcaacatgcaaagccaatcagatggcataaatgaggagaacgagatggttttttgtgtgaaagaaatacaatattgtatgattttgcatgagcggttgaggttcgaagctcaaaataaaactcttttttttttacaatataaaacacttcccacgatatcttcctcgaactcgacttcccttataatatcgccaaatcttgagatatcgagtccgacaaagagttgacttctggctactgtccaacttctatcggcatcttctatagctctgccgctgatatattctagccgatatagctttagtcgatgcaatcttctaactttagatcccaaaatcatgccgtcaataccactctgtgctttccccttactcaatggaatatgtcaaattttgctatgaacagtcactcaaatagttgtgaaaaaaattaaaaaaaaagatatattaacatgtgatatataactccacaaacatgcaagttcaaattcaatttctacatatcacaacgaaaaaaacaaattaaactacacctagttaacgtatattcacagtcaaatttgttttttcgttgcgacatgtagaatttgaatttgaatttacatgtttgtggagtgatatatcacatgctaatacatcttctcaatttttttcaaactttttcataagcatttgagtgacatgtaaacgacaagaagacgttccctcgatagtttaaaacccactctcgagaaactgaggggttgttaagttcccaaaaaacttttcctaaaaacatcacatcgaatctttggacacatgtatggagcattaaatatagataaaaaaaactaattgcacagtttgcatgtaaatcgcgagacgaatcttttgagcatattagtccatgattagccataagtgctacagtaacccatatgtgctaatgacggattaattaggctcaaaagattcgtctcgcgatttctaggcgagttatgaaattagttttcttattcgtgtccgaaaaccccttctgacatccggttaaacgtctgatgtgacacccaaaaattttcatttcactaagccctgaaaccaccttcctccgtcactctctcccagcatgacttcaaaatcaacaccctacatccctaccccataaccgtagagggcaaaccaacccaaaagcgcacacagcgtgaccacactggtcaaagagcaagaagatgcagactcatcatcactcactgctggcagaaggctacaacgagtgggagaagacatggaagcctcaccaaatactaaaagaacacccatactcaccactgagtgtgaaacaccgatactttattttcttgccgtacgtgtatcggatactccatcgatacggtatcgaaggagtatcggacacggacactaaacagtgaaaaaataaaaaataattaacgatactcgtaccatacttattggatacttctctgatacctagccctataaccacttgttcaatagcccattaaaaccccaatgctacactactaatatattttataagtttagtactgaccatatttattatttaaggttacaaggtgttaagcttgttacttgtttgtaagaggcaacaatgcatagaattttgttttgttaaggtaatcttattgttttaccttctctatattttagttttttaaaaatattttttatatactcaccgtatcgtcatgttgatgtttttcaaaattcccgtatcaccgtaccaatatcacgtatccatgcatcatgactggtaacacatgcaattaactacatcaagcactccgctctgagagctgtcctctcctttgagaacccccaaatagcatgaatcccaggataactctaacgataaaaaaattgactgaaacaaaataaaatttaccgccatatctgatcacaaaacgattacaaataacaacaatgacacaactcaaaagatcggacacatattcaaatggttccctctaaaaccattttattatattactgtgccatacagttttgaaaggaggcaccacgtttgctttggaggctaaaaattcccatattgatcggagaaaaagaaaagaatagtccaactagaaatacaatttaaaataactgaaattcataattaaaaataagcactcttgaaaaaagagtccatttaagaacctaatacgagatttattaacattcagaataaaaaataaaataaaatccgaaattagcaaaaaaaaaagaaagaagaattcgagcagaaatataatttaaaaataaataaaattcgaaattaaaattatgaaatattgaaagaagagtccatataaaaaacctaatacgagattaatttaaattcagaataaaaataaaaaatagaaaatagaaaataaaataaaagaagagtactgaaagttggaattaagtatagacaatattgaaataatagtacatataaaaacccaatacgagattaattaaaatttagaatgaaaaataaaataaaatccaaaattggacaaattaaaaagagagttcaggaaggaatacaattttgaaacaactgaaattaaaaataaaaaataaaaaataaaaatattaaaataacacaattcaatattagttaatattcaaaataaaaaataaaataaattcttaaattagaaaaataaaaataagatttcaactaggaatacaatttataaataactaaaattgatgataaaaaataaagactattgaaagaaaagaccatctaaaacacatgacgagattaattaagtaataagcatataaatgagtatagtggtggcggttgatgggacatgtaaaaattattaataaaacaccaaatataatcttaatgacgattaaaatgaatgatgatggataggtcgtaaagcaaccggttaaggcggttggcgggacttatagaaagtcgaaaaataaaccccaatgataattatatttaatttttaaaatctcaatgacaataaaaatgataggcaacgggcgggtcgtacagtagtacaatggcagagccggcaatagttgatgggacttctagaaagtaaaaaaatgaattccaacgatagttatgttcgattttacgaatcccaacaacaataaaaaataagcggcggatgggtatagtggcaacgtttaacgatatttctaaaaattataaaaaataaaatccaacgagtcaataaaccctaaaaactataaggtccaattttaaaaggttcgggcttctaaaaagttttaaaaaataaactccaatgataattatgtttgattttaaaatctcaatgacaataaagaagggaggcagcgggcgagccgtagaggagtacagcgacaaatccacgaacattttggcggaacttctataaagtagaaagaacctaaacgataattatattcgattttgaaaataccgaagatgcagcagactggccgtagaggagtataatgacaacgtttgacagaacttataaaaaaaatctaaatacgaaacccaacgagacaataaactctaaaaactataagatccaatttttaaaggttacaaggagaatgaataggaacagtggaagaccgagcaagcaaataaaaaaggatatgacagaagtaagggatagtaagtggtgtgactttttaaaaactactataaaattagaaacatggggattttaagatttggtcttttatagtcttataagacaacgaggtggttatttaataaagtttaagtaaaatcatataaaaaaataattgtgtataggcgttagccttgcgcgggccacccagcaagttgactatgataaaaacctttaatcgatccttcctagctcagttagagtaaagtagggcctcaaatcattgtggttggttcagtgatttgaggcccctggccagataactaaagcacccaatacatcatttcgctggtgagcttgtacatctcagacctgtgcttcagcatgcggagccctccaccattggcaccaccaccagcatcatcctcatcgtcatcgcagcgctccacctcgacggcggttaacacagcgaacagctcctcgccatcgcgatgatcctcatcggtgcggaagaacctggcaatgcagaacttgccggagcccaggttcacgaggtccgagctgacaagattgagggcgtctggcggtgtgaactccataggaaagctgcgaagcagcggcagctcgccgccatcaaggtccagagcggagagcaccaagctcctcttcctcctgtctctggtgctgtgtgagaggccaaaccaaaggccgtgctcatggcaatactcggcgagaccaacaaatggcagcgtccatcttgtggccactgtgctccacgcatggcgcaccgtgtcgaagcagtagatgccgccattgtcgtgcgtggataaccagatgtccgtgccaccgatcacagcgtaggagtcgacttcgaagtcggacagcggcggcggcgggagcgcgcagcagcgccaatcctcgttcaatccatcctcatagatgagcccatggaagcttccaccgtcgtcgacatcgaggatgtagaggtcgtcgccgacggtgacagaggtggcaggcaatgtcacctggtaggggagggcgggcatggtgcggacggcgtgctcgccggggtcgtagaggacggtgcggcagctctggtcggcggcgaccaccatgttgtggttgcctccaaggaggaagaactccatgttctggttcccggacaagctggaggagggagggtagaaggtcatggccgggcatggcaggctgccgtactccaccgcgtcggcggcggcggcggcggatggcaccggagatggacgtgggaggaagaagcggtccatgtctatgttccgcagcgtgtagttgctgcggcgtggggcgaactcctccagcaccagatgaacaaaccgacgaacactcatcgtcgatcgatcggatgaatcgatgatcgtccccaaaatgaagtaatcttactaaagattgattggattgattggattggattgctctggatcttcttctcccccaccacgaataactagggttttcacgaagccaaacgatctttctcgttgcaaagcgacttatccgattcggttacgcggagtggagatcatgcgggcgccctgatcatacgatctatctctatataaaccgagctgccgccttcacgcaacacacgcgaaatcaatctagggtttgcctcctactctgtgctgcacctgatcaagcgatctatctctatataaaccgagccgccgccttcacgcaacacacgcaaaatcaatctagggtttgcctcctactctgtgctgcgccatcgctcgtagactactccatcccactcgccggtgtgcaccggcgatcgggagagtagatctccggaacaatctacggtttgcctcctactctgtgctgcgccatcgctcatagactactccatcccgctcgccggtgtgcaccggcgatcgggagagcagatctccggaacctctgccttcgacgtcatgcaccgggagaaggcggaaataaggtttttgggaagcgcttcgcgcgactgctccctgttcgtccgcgatggctcgccttcctcttcgctcgcgtgctgcgcaccttcgtcgacgcctgcaaccgcgagtagtccctgccgagcaaccggtctttccgccacctcggtacgtgttcgacatgttgcgcatatttgatctgttcatattttactgtttagtttacatatgtagacctaatgatgcgttcatgctagtttatatctgcaatgtcatgatttatttatggaataaattaaatcattatgtgcttataatttcaacataagcgaatcggatagtcaccggcggcggacagatgatgggaagggaatggcggaggaagatggagtggagagaggggaggaggagttggccaccgacgaggtccactctggtggcggcggagaagaggggtgagtgcgggggcgtccgggggacgcggcgggtgggaagggaggaaggcgagggcgtgtgatctggacgtgaataatatttaaagctatgtgtgaactgtagataattataactagaggactgctacaccacggactcccgtcctaacgggataacttaatgaggattattgtttgaccaatcaaccacttctgtcaatctatccacttcacgtaattccatacaagggtcaaagcgtcagtgtatgttcacataatcacgtgagagtctacaggcttatggttgtctttcagtctttcactagagacacaacacactaggtactcgatacttaggtggtaccaggtaccggataccccatatatcataatatctagtactgggtatggtacctttaggtatcaggctggtctaggtaccaggtatatgatacctaggtacccaacgtactcagatggtaccaggtaccgaataccccatgtaccatgatatcttagtactaggtatggtacctttagatatcaggctggtctaggtaccaggtatctgataccccaggtactcgatgccctataccagatctggtacctatgggattcatgccgatctaggtaccaggtaccttgctaccccaggtatcaggctggtctagataccagatatctgataccctaggtacccaatgcccagtaccaaatatggcacctatgggattcatgccgatctaggtaccaggtaccttgctaccccaggtatcaggctggtttaggtaccaggtatatgataccccaggtacccgatgcccagtaccagatctggtacctatgggattcatgccgatctaggtaccaggtaccttgctaccctaggtatcaggcctgatacctatgatatcagtcgaaacaatctgggtaccagttacatgatacctatgtattagaaactcgatacctaagcattaggtatcttgtgggtatcaagcatgtttcatggatattaggccctcatgccgatgggagctatgagaaaaagggaaaagagacgaggcaagcacaaaaataagatggctatcttccttggaggtggaagaacactattccttcttgttgccatccttgattcggatcgccgctgctacatcctcgacacgcatgtgaccatgatggttatggacatcgcctgtgacagtaggacggacacctcaatctctcctcctagctcgaactcattgaagctcttcctaagcacctagtacacgagagttcccatgaccaccatcaacgatgtgatgttccgcacaacgagagctaacaccgctctggtcttgtcgcagggcttgcagtgagtacttgcccagccacattaattaggaatgaagagaggagttagagagggagagaggcgtagaggaggagaggcgaaggaggaggacgaccaagcaaagctccgggagagagaggtagaaagggaacagataagattggatatcgtttcacttctcccgttcctacggcattccgttggctagtttttctgttataactatttttagacgacatacggtgctcagtgaaaatatacggtgcttctctaaacttgctttccgatgattaataatcagctgtaatcaaagctgttagcacccaatggagtacaatatattgctgatgagcttatacatcagagacctgtgcatcgccgtcgtcgcagagctccacctcgacggcggtgaacaccacgaacagctccgggccatcacggtgttcgtcgtcggtctccaagaacctggcgatgcaggaacctgccgacgaggtctgagccgacgggattgagcgcgccgggcagcgtgtaatcccgaggaagaaggctgcgaccacaccggcggcttgccggcgtcaaggtccgtggcagagagaggaccatgccactgccatcactagccggtgagaggccgtgctccgggacgtactcggcgaggccgccgatcgaacggcagcgtccagtcgtcggcggcgcgccgtgtcgaagcggtaggtgccgcctccgccgccgaccaggagtcgggttggaagggaggcggcgggagagcacggtagcgctagtcctcgccgccgtggtcatcgtaggcgtagatgagcccatggaagcaaccaccggcgaccggcgaatccgaggcgttgaggcaggtcgggaaggcagaatccgaatccgaatgaggacggtgtgctcgccggtgtcgacggcgcggcgagtctggtcgactcatcgccgatcgattgaccatttgacctccaagattgtttatctggcatcctggccccgcctgccatagactcatcggtctctggccccacctgtcatagactcatccgcttctctctgctcgttagttgccttcgtcctcctgccgcctcgggtgttcttccttcctccatcgccatggcggcggcggcggcttcccaccgcgtgttcgtctacgggacgctaatggcggaggaggtggtgcgcgtcctcatcggccgctcgccgtcctcctccccggccgtcctcccaaaccagtccgtccacgagacatctgtttcttcttcttcttcttgccaagaatcccctcctctctgctgcgaaattctgatcggccaccgtctcctgcagccagaggttcagcatcaaggggcgcgtttacccggcgattcttcccgtcgacggcaaggaggtctcagggaaggtaagcccctcttgcttcctctctcggttaggcaatcaaagattcaagaaagctgaagagtcaagtgaagagaaaaatcacaagtgcttgttgctaaatcagcatgtggagaaaattaaggccagttaatctgtactcttcttttatgtatgttgtgcaggttttcaagggcatcactgacagggagctcaatgtgctggatatatttgaagatgaggagtatgtcaagagaaccgttgagatatcactaactgtaagcctatctctactatgtacttagcaaattccgattgtttagattgcctgaaattgctgcttcagcagtctgtcatgctgtactgaaattctgaatgttcagcaagattggaccctgtgtcttgaaggagaaatgttttgattagcttcttcttttcatcatatggcttcagtaagatgggatggtttggattttcaggacacatcggagaaattgcttgcttatgcatacatttggggcaatcaggatgatcctgacctctatggtgaatgggactttgaggtgaggatgtttcctttttttaaaaaaaaaaaaaacttccatatgccataacagtgtataacgtcctaacactatgctatcatggttcttaacacaatgatactcaattcacgtatttgcgaaaccatgttatcataatcatccaatgcaacaacctggcagccaacaccatgagagctgcaagctcttgcagaaatagtatatgcatccgtagaaagccatttctagttctactgtcagttcagcaatccttgttcctctgagtgaccaagatcactaacttcaatcagtcatcaatcatttaacatagacgtgaatcagttggtcaaattcgaacctgaatagaaatggcatgtcagatcttttggttaattatagagcacacactcaagaactggtagacttatactccatggtcaattagctgtgtagaatgtttactgacttttgagccctgctcattcattgctcttctctcttctgctgtcaacttctttgaatcttctgttgtcgaattgtgatgtcctcggtacctttaattcctgtgcaatgtgttatctgtaggaatggaaaagggtgcacttggaggattatgtcaagatgacacaagagttcatggaggaactggaacagctcgaaccaaagaccgagacctgaagctcaacactcattcgtccagaaggattcactcaacaatgaattgtatgtgcattgtcaaatggttctcctcttgtttgtaaataagatgtttacaccattaattgatagacaacagttacagaattcgcagtggtttcaattttagtgcttataagcttgagtgcaaatacatataatttctgtgcttttgaatcagtccatattttacatgtgatgatgtgaaacaaactatcttcaattcagaaattgattgattggcagagaagatgacaggataaagaaggaaaggtgcagaatatttgctatagtggtttctaatctgggtctgatcttaatagaggcttgaacaaccccaagaacagttagggcaaatgttttctctaaaatacactatcttaaatttcgcctaaaccctgtctcaactcgttaacagctctaggtaagttccattcttatctctaactttttgcaaatgcaaaaactacacaatatatcaaaagaggaaaagaaatattctgaggagcatttgccctcccagctataagctgacactctacactgaattcggcgcatagccttttaggccacggatttgatgatagttatgctgggtttttgtagccattgcatctcttctgatcccattctgaattcataatggacgcaaaataagacagggatgtcaaatatttcatatgtgaatgaacctctaagtcaggtcattcgaattgatcatacgggccgatggaagggttcccggggttctggtcacagcgaggcctccaaccattcaccccatctgagctgctgcaagcctggttggggaggacattgctccccagatcaccatccaagctcatctgttgcacttcttgaggtgatagaatcctaatgcatcttacacagttcacaaactccctacataatccgcaacagctcatattagaataactaaccagtaaaatctttcatcgaatagttcacttgcacatcttgtacacgcattgtttttcagtttatgaataaacatatttttctgtcatattatcatgctggattaaccatatttcactctggtaaacatatctttagctgtcaattttagcaatctttattatcttggggcctattttagagcaggaaattaaaggttcacataaggagaaagatagatatacttactcccatgggtcatcaccaagaagcaggatgtcatcctcgtgatccttgtagaccagtttccagcctattctctgtcgatcttcaagttgaccctctataccaaacatgcgagccaaagcatgcttcaactcttcatatccagagtacctgccgatgtcaatagaccggcctacagctcctcgtttgtacacctataattcttagattaggcttactagcatacgagccacaaaaacacacatcttgaatgctacaccatcataacctaagctaaggaaaagccaataccttggtgaatgtccgcattctctgcagcagaggggcagcgggccaggaatttttgttcaagaaggcaccatcattgatcgcagaatcaatggaattaaaagccatatccgactgaccaaatgactgggaaaccatggaggttgatatttcttgcagagcatccttttgcatcgggtagttgttttcaacatcagttgatatgtgattctgatacttgacagaatcaagtgcatttatcagcaagtcctctgtttctattgggaatcctaacaggttatcattgttgatcccaaacaagccactgttacttggatccacaccttccatttctacatcaggaagtgcatctttgaacatctggtgttgattgaagttagaagaggggaaaccttgatgcacaagtccatctgttcgggaaggacataatgaagttgctgatgaagatgtttccaagttgtctgtttgcaatgcatggtttatacaattttgtgggccaggagcaacatttggtaattttgagttgacaacactttgcttcacattattattcggctttggcaattccttggtcattagtggagttgctgttacagcgtcaatggaggttgggatcaacattggagcagtggacggtggcagcctttctgtgttgatgcaatgtctgtttttggttgattgtgtaaagtggtttccattagctgtggatggagatgttgaacaagagggcatttcctctgtaactacagattgtgtagcacccgaaatgatcatagcacctccagttttggggatcacattggttgatgaaattggttgaaaagcaactcctgacacatctgcaagtgagacttgtttctgtaaaagcttctgctgttgctcttgctggaccgtgggtagcaatggtgttgcttgcaatgaaggcttgatttcttgttggggcatcatttgttgctgagcaagtgaatgtgaatttgacaactgcttttgcatgtccgtgattaacttttgctgttcttggatcagaggtggctgtgagagtgttgatgtggattgtgacatcagtgattgctgctgcagtttctgtaatatctgcaactgaagctcctcatcaaacaacttagactgctgacttgccagatttaccaactgtccaagggacttatttagctgctgctgattctgttgttgctgctgctgctgctgctgtaactgttgtttttgctgaagtaaaagctgctgttgcagctgtaaattttgatccttctgttgatgagacaaaagcagccgctggccattaatcctttgcgggttttgagttggagatggcttctgctgttgcatctgattctgaacaatcacctgagcctggacgagattagattgagcttggctcaggggaatcacttgtatggagttctgctgtctctgatggttgacagcatcttgtttctgatcttgaggattgatgatagcaccaagctgattcaacggaattgccgccttggacagatcgttcatggtttgcatttgctgagggagcttgggagaattaaactgtatgcagttctgttgaaggagattgttctggacatatagttgccttgcaagttcatcagcagcaaggttttgcatggcagggttacctagagcttgcaggtactcagactgcgcagcggtgttagccaatgatgagctctgctgcctgttcatgttcatccactgaaccaaacttagaccaggtgctgtactgttctggttttgagtatcctttatgcatacctcctcaccaagccaaggcattgccctcttgaaaaggttttccatctctgactcgtcatctgttaattcagataaaagaatatgaaatatactaccataaaaaaaacatatgctaatgcgataatgtaattagcctatagcaatcctggtttcgaaatttatacacttgttatcctgttcagtctactataaccatacacaataacccattaagtaattccgcatcgatgtctaatgtttaacaaatatgcagaccaattgtttccagcacacatagaataagtaaaaaatatgagcagagaagtaccaaactagtatatgcgcatactgtttaaattaaggaaaggtatttgcaaccaaatgttcagaggccatttgaaggaaatcagtgttgagtattcttgttgaacatactaatatcagtcatacctaattgcctggggcgcttcacaccaaaaaaaggttggggacatagaaaaaagggagctgcaaccggttcaatctcccagattgaaactctgttcctcctttcaccagctgcagactcatcccagccaacctatagaaatcaaatcagcgaaatggaagaaaaatgaagggtggaaaaagattaacacaacttgaaaggtattcaggaattcaacctgtaaattgcgccattgggagtttttccatctcacaggatctaggtcacttattccagttattgtacccatgtacctgaaaaggtagatatttacctatacggacaacatagccatgatttttttttctccatgttttaaaaagaaagcaaaatgcatgaatctcattatgtttcaaaagtatgtgttttacggataataaatgccagcgtaccttcttgttcctaattcctcggtttcaaacatcatgcgaaaccgcattcctaaagatatctgattactatacagtgccttctggtattttgcaaatgggataacaaattcagtaggactggccctgaaagttcatacacgtcaaaacacaatactcagagctattcagttttgtctatacaacttagctattgaatgtacagtaaacaatacagacaggagtataaagtcagcacgcaaacctagggttataaaatatggtaaaagggctactgttggcagcagcatgggcagccgcagcaaggactcctatgtgcatactgtcgcttgaaagtactgaagatgatatattagtcggttgtctgttagcacgcctgattcctagtagaagttgatgcttttcatccctgaaaataacatgacaataaaaaaaaaagggggcatttacatcttggattttgctgtttattctgtacctaaactaggagaagcttttattagatggaactaaggaaagaagcatggagttcacctcacaacaataacagaatcaccagcaaataacctcttgccactcacgaaaaggctccaaccagtagtaagtaaatgtctttttggttgacctgataacacaaagcacagaaataattaactgtctccaaactttacatatacgcatcaaagacattcaatagaagtatagaactagggacctctgttaacttttataaaccataagacagacattatcgttcactattaattagcttaataatagaaaactgatgcagaagtggtacccatgttggtattattataggaaaactatagatcaaattcaatttccgaaactgcaaaggcatactctgccttaccaaggtcaatggaggggctatccagaacaaaagtagatactagatgcatggagaatctcatttatcctgccattttacaaagaatgttatactgaatgttaaattttccacacctcgatatatatgacgaaatgtccacacattgtcatgtatatctctagcttgcagttcttgagctggaggttgcatagagaagtcctacagtgcagagtggcaaaattacaatggtgctaagaacagatcttttgttgcagaaaatcagaagatatgaagcctacataccaggggagggaatatcttctctgcggcacggcgaggcacagagaatcctccatgtgtacttgtatcacttgcggtgagtgtcttacagaagaattccatttgtggccttgcttgttttagtgcaagctctgatatttgcaacgcctcttttccatactgataaaagcaattgatgagtgcatttgaacagactaggaacttttgcggaaaccacaattttttgtttgctcactgtattcactggttgaagagtcatctgtgcataaacttcatcagtatctgggtctgcctgataggtaaagataatgattttagtattgctgattgctagttcttaaagcaaagagaaaatggaaggcaagtagctttaggtacatgcaaattgacaccgtgaagaagacatatcaacttggagggaagatttgggtagcttggaacatgtgcatccacatccttttgcatagaagctgcaacctgaaacaaaaagcttagattaagtagatattctgctgtttccaatagcatggagaaagcatttcttaatatctgaaacaatgaaaaatgcagtcagctgaaccaagtagccagtatatgtggatcaacatccacttttttcaaactgaaaaaaaaggttttgtgctcaagaacatggaagtggaaaaagaaaagtactactgcactactctgtaaactagcactcgataaccatctcataaaaatttaagaaagtacaacctttcaaacatactatgttacttttgtacacctgtcaacaaaatttcaataaaaaaatgaagtttcgtagtgtccagtccagaaagtgcggttcatgagtgaactttttttagataaactcgcataagtacaattaccatcatgtgcagcgcaaccaaatatcattcatgaaaaaggaccttttttctcatctttctaaaaagaaatgcacgaataattgcaggattagtcctcccaagactgtctattgacctaataattaattatttattttttcaatcagagcaccataccttaccatttgacaaaatttctcaaaacaagtaggagtatttatttattacaatcggttggactagaaatgatccatctcagggtcatggatgcaagaaatccaaatcccataagatgcttcatggagaccaaaccacattaacatcgaaacagtactcaccatactagtagggcaacagaaaagggaagccagtaggcccaatgctcccaaccactttggtaatgaacaagtacagttattagtagctacatacaagcagagatgtctctgctagcaagtaaaatcctcacatacattagcagtgaacaatgcatcatgtgagaaatactcttcaactcttttgttataaaaaaattatcttccataggagatcaaatatccaaagccaaaagtttatttggggtgtaagtaaaacatttgctctgagaaggatcgttgcactgtatcaatcactgcaacagtacatacagaaagaaataaagaaaagttcttttctgtaattaaccaaaagaaaaaaaattcccattgaacaacccacagaaatctgagagtttcacctcaaaacgcacaaaaaagaccacaaattttcaaccttgccatgagcagcagcatcagattaacattatactagaggagaggagagagcatccaaaatacagcagagattaaacagcaagaactgaagaagtcttcgatcaaactaggtcgatgatggaagaagaggagagagagagagagagagatgatgatgacctgctcgctgtggccttgcgggaagtagacgacgaggctgcccaccggcggcagcgacacgagcgggccggcgcacgcgtgccacagctccgagttgatcgccgccgccttccgctcccctgcaccgccgcagccgccgcgtcagccaccgccaccagacgagcgaggagaagagaaaaaaaaaagcagtataccttcgcatgcggccacggcggcggtggcggaggaggaggccgccgccgccgcggtcaccgcggagctcgccggcgtctgctgctgcttcatgctcgccatggcagttcacttcagagtcctcctcctcctcctcctccacgcatggcacgaccgccgcgccggcgccgcggggttcggcgctagctcttgccagatgaaccacgcacacaagctcggctactccggcggcggcggcggcggcggcgaggcgagcagcagcagcacgaagagcgaggtgcgctctgcggcgtctcgggagtgggaaagcaaaaaaacgaaacgcacgcggcgcggcggctctcgttctgctgctgctgctgctgctgctctggcctctggttgctcagctagcaaagcagctggtgtttttcaagtgcgtcaaaaaaaaatatcagttcttctattggagaaaaaaaaatactagtagaatattgttttttttaacagtggcagggtttagttcccttcaaacttcaaaaaattccgtcacattaaatgtttgacacatatatggagcattaaatatggacgaaaaaaaatcaattgcacagtttacatgtaaattgggagacgaatcttttgagcctaattacgccatgatttgataatgtgatgctacagtaaacatttgctaatgacaaattaattaggcttaataaatttgtctcgcagtttacaggtggaatctgtaacttgttttgttattagtctacatttaatacttcaaatgtgtgtccatatatttaaaaagaattggcacacgaactaaacatacggctagtgtaaaaaaaattgtttccttgcgaagagtaataacttttgtgtgggcatgcaaatatgcaatcggccgtttgggaaaatgtcgggaagatatacgttggtcctccgtgctctccctcttatcataaaaccatgaatatataggtggaaatagtatgacagtcttgagttagcatatatatttggtagagtttcaaatctctgtgtttggcagagttttaatgtctgaaatagcttagttgtggagctgacaaaaagcaatctcacccttcttatgtttttccaatagtggatccttctaaattgctcttaaaaattaagaatctagtattatttaattcgggcgactgtatactaaacagatatccgaaactgataatagtattaagtatctagggaagtccatcatactacaactactccctccgttccaaaatataagtattttttatcctgacatatggtctccgagatgctactttgatcaacaatatctataaaagtaagatattttaaataaaaaagttgcatattagaatagtttgttcaataataaatctagtaacatcaattttacatgattgattttttttccctattaatggttaaaataaaaaatgtttgacttgttacttttctaaaaatgtttatattttagaacggaggaattactatgttactatctccatttgaaaaagaatcaatttctaaggataaatttggatctagaatcatacctaaagttgattctttgaatgaggatgtaccactcggcaaagactttttttttccgaaagaccctaggcaaagactcaacaagacgagtggacgatgttagtcacgatcgagtagctaggatatatggtacgattagttgggatgttcaaggaaatcccgcgatttgtccagctaattataaatcgatcctggagcatgtcttctgtaagctagcttgttcgatcgacgtcctcatcatcaaacgccatttgtgtgttttgtactactagtacgtgtgtgttgcgtccacttgacacattggtgataatttgctaatcattttgtcagctctgcatcgtggaaacacaatgctcactactagtagtatactagcatgtagcgtgctcgtccgttcatcctagtattttcataaaaataaacgtttcagagcaggtacaatagtaggctataaaccagctgtaaatataatttaagaagataaataagaagagaaaagagcagcgggctatatatttatagccagctgtagcacagatttcaagacgcagtgtgtgtatgacaggtgggaccaggtattaatagtgtagtatgtaactattgtatggataagctattagattggttatagataaattaaagctagtagttggcttggataagctattagattggttatagataaattaaagctagtagttggctatactattaaacttgctcttagagtatatccatacaaacatgccaaacttaccgtcttggcactaacatatttatatggtctgctcatggtgtgttttgtagtacacgctccttaatttctactccctcgtctttcgcacgtacgttttccgaacatctaagcattgtatattaaaaaaggttatatagaaattatttttagaaaaacatattaaaccggccatttttcaaggtttttatagctaatacttagttgatcgtgtgctaatgagtcaccctgtttgcatgcaccctcaatagcctcatggcatgatcataccaatgcacagaatttaaacgatttttgcgagagttttagccatttagtcctataagaaacattctaaaattctgttgtttcaaaggagaaatcagttgcttaacctttaaaaaaagagcgggtacaataagctgatactataagtataaatgaggcgtacaagttatcacatcatacttgtatttatgtggaggagagagaagaaaaacgagctctaaatttatagtcaaccgtacagcacaaacttcaatatactgtgtgagagagataagtgtgttagatattaatgatacaatatgtctatatctatatattacttagtattccatgagtaaactattaggttggtcatatataatgccttaattttttaagctagtagttattatattattaaacttgttctatgattttttttatagtatgttaagagggttgggattgtgattagcaaaatgagtgcagggttacgataaaatattaaaatgagtgagagggagatgataatggaaggcagaagaaatcgactaacctctaatatccaaaagagaatcatgttgataggtgatttttttttctcttaatccattatccaaactggctcaaacaccacctaagatggtatttgaatcttctgaagatggagatgaagatgaatattaagttttttacgtaaaacgaggtggtattaacgtatgattgattgagttttaattattacaaattttaaaaatggattaatattatattttagagcatctttcatatagaaagttttcgtacgaaacacaccgtttagaagtttaaaaaacgtgacacggaaattttaatctttatctaattctggttggagaaaaaaactgggcctcaagactcatgtccaagcccaaccctgacccatctgccttacgacagtgtacggcttcgactgcgaggggtcgatccgacatgggcagggagggagggcagcaaggggttgcgatgcgtcgtcgtgctcgtcgttgccgacgcccgcggcacggcgacacgtccggcggtcgccgtgcgtcgtgccggccggcgaggggacctttttattactatatcccctttccagcatggactactactaccactctttttcactcctctagctgctgctctgctcagaggctcgtgagctattcgtagctaggctttcgccagccggcggcgaggagttggatgacactgacgcacgtactgtcgctgcacagcggttagagcaagtttaagagcacccgcaatggtaaagtaagttgctatctataaaacatgtacatctcagcaatagactcaattaatagtaaaccaccttaatagtatgtctacattggtatctataattctctcatgcattgcctcgtttttctctatagactatctctaagttagtagatagctttgctctctctcttcatttaataccttccaagtagaaaaatatgctgacatggatctcttgtagagagcctatagataaccattgtgggtgccctaatagtatagctaattattaattccaatttatctatagccaatctaatagtttattcatataatagttatatactacactattaatatatggtcccatctgttatacacactgcatcttggagtccatgctatagctggctacaaatctgtagcccgctactcttctctctccttattatctacttaaaatatgtttataagccaggcttatagcttacgcaattgtacctgttcttaacggtggccggcgcggtgacgcatgcagtactagtgcagagaggtggtcggattccgaggagctctcctgttctgttattgtcctttcaaacttctaaaaattttatggaacattaaatatagataaatgttgtatttagattgatccaaagtttaaaatttggttgaaattggagacgatgtgactgaaaagttgtgtgtatgaaaggtttgatggaatggaaagttggaagtctagaaaaaaaaactttggaactaaacacacccaaaataactaattatgagacaaatcttttaagctaaattacgctatgatttaacaatatgatgctacagtaaacatttgttaatgatggaataattagacttaataaatttgtctcacaatttacagacggaatttgtaatttattttattattagtctatatttaatactatatttttatatattgtccatatacttgaaaatattttggtcagacaactaaaccgtactacatcggttgtgtagttggcacgcttcttcatcagtgtggcctcggtgcccgcgccgccgcgtgcgccgctctttcatcggtgcccgagctcaacacacacacacacacacacacacacagccctgccctgccttctctcatgcgagacccctccaccgaatgtagtttcggcttggctagctccagagaaaaccatagaaaaaaattccattttggttatttgagacacaggattataaaaacgtaaaagtagaataaaaaatacatgaatgaatataagtagaaagtcatgtgtagaatagagtatcgaaaaatggtcgttgtttcaaaataaatcaacttttgtgttgattgagagatacgtaaaacgagatgagccattaacgtatgattaattaagtattaactatttttaaacttcaaaaatggattaatatgattttttaaagcaactttcctatagaatttttttttaaaaaaacacaccgtttaatacttcggaaagcgtgcgtgtggaatacgaaacaaactcaaagaacacaccgttttatcatatcgtaggttgtttaattttggactgaaggagtatgcattagatggagcatatgaaaaacataatgaagggccccctttaaaatgtaagattgtcaaaaacacgagaatagaaaaaacatagaaatatgatgttatgtccgttggatttctaagagatttgaaaacacaagaaagtttcaaaactaccgtttgatagccatacaggaaaaacgtaggaattcaagacacggaaagaagaaaatgtgaggtaagacctcaatgatatttcttgaattttctcaaaacaatggtacttccttcattttattctctccatatcaatgaggggtacagtgatattttaatcacctacctaatttgtttttaactagctataactatgtcttgttccatagtaagattaatacgacctcatacctcatactctttatttcattctatgtggtctccctagtttcatgtgtttctttctatacaagttatccaaaggcataattttctaaattcttatgttttgggttcctataaggttctatagcttacaacatttattcatgtatttttcttgttcccgcatttcaaaggaggccatagactcgtgaagtgagcgtaactcaactggttaggttccttgtggtggaaccacccggttttaaatcctaaatttgatacgagtgctcgcatttacggctaattattatttcagtggtagacgatgtacccgtgaatagcaaggcgccagtagtgacttcgtcaatctcaagatatacccgtccagttcggaggtgctcataggggtagggtcaacagcgaagctagtggtgactttgtcaatctctagatatgccggttcagtcttccggaagtgcttataggggtagggctaacagcgagacgctagtggtgacttcgtcaatctctagatatgccggtccagttttccggaggtgctcgtagagtgtgcgtatgtacgtttatagggatgagtgtacgtgtgttgtgagcgcctgcgtttatacatgtttctaagaaaagaggccatagactcaaagcccgaattaaactggctccaactaatttagaaaaatcggtttcactttagtaaacatgattaattattagagtggtagattagcagtaattgtactaccatacacgtcacatgagtacatgatggtgctccgtacttgtatatgtaagcacccatacttctacttgaaacctcgacagcgacaagtgccaagcactagctagagaaccgaagaaaagacatggcaaggtcaaatggccacgtagcaactcatcaccaaaaagatagtactactacaaattatttttcttttttttaaaaaaaaactcaacagcaagaagccaagatacccggtacttgtagtggtacaacatgtgtaggcaggtcaggtcaggtcatgtggtcaaccagccaatggaaagcaaccgagagatgccttccatggattaatgtgcatggtagtagcaaatggtggccagcatatcgttcgatttttcagacacgggacaaaaatcgtagggactcaatcttttcgctttatacttatccgttaaaatttaaattttcaatcttaatttaaagctgattttaatttttttttattttttagcattttacttttagatttctagtaacacgtatataaaagttttatttaccaattacttctcgtttgtgaatatacgtttggcttattccacgaataaaccaaacaatgagaccggtactcgattcaccttttaaacctctcccttgtcttatgaagtataatgaactaaaaggacaagtaatttactcctttcatcttaaaaatacaaaatttgaaaataaatttggacagtgatagaaaagttagaagtttgaagaaaaagtttggaagtaaacaaaggctaattcacctccaggtggagttaccgtccgtactgaaaacattcatacggcagacatattgacacaagataatttattataggagtagaaaaaggaaaaaggaaagctgtcctgaatggggagcacacatcgatggatttgccttgtctcctggcagtgaggcaaagcttattctctggtctcctcttacatggatcacgcccaagacagctttgtacgacctaacatcacctggtcagctctaaattccatctctctctcgtcacgggccgcaccaccatcagcaaccaccaccatcagcaaagattcacgatgctgtaattatgtattaactgtaactatgaggttattataggatatacaccctccgtcccaaaataaacacagctataagctttcgtacccaactttaatcgttcgtcttatttaatttttttttgaaaaagctaaaaaacataaatcacgcataaagtactatttatgttttataatctaataacactaaaaatactaatcattaaaaaatttaaataagacggatgatcaaagtttggtacgaaaactcatggttatgtttattttgggatggagggagtaattcacaaaatagtaaacggaattgcttatgaagtgatcttacttcatcttagttttattagcgtagatgtttataaaaggtctactactcctatgtgttttaaaagttctttttttatgaaattaaggagagatgtggaattaagtgagtgatggttgtaatttgattgagatgagaaaataagtgggcaagtttgtttaggataaattttgaatgttagcatactcttatactaatgcgaacccgctagggtttgtggcccgatctttcgatgagaggtaggggataactcgattggatgaagacgacgttcacggcccgactacaaccgtccaaagacgctgcgccttagcaaccgatacaccatctccaatggtcgccgcgaacttgtggtgcgcgtcaacccggccacgagagcactcgtcctgcaagcaatcgaagaacaagcaagaacaagtagaacaagcactgaaattgctagataaagatgaaagtttcactatcaaaacacaatatggtggggttccgattacaggcagacgggcggtttagccaacacgcgcgctgcgagccggtagcaagtagctatctctatcatcaaaacccgagaaaccctgaaggggtacctagctatttaaggatgtgggaggatgaccaatggtgccgtagggtcgttctccaccaggttggggcgcaccccacatgggccccacttgggccggggtcccaggcgaagttacaagcctataggcccattacaggtgacgcagcaccttgtttctgcgattgccgtcgactgagatggaatctgggaacaagactggatccgttgaaaagaggacttggagagctttccatcaagtactcatagacccaaaacggagctcgtatgaaaatttggcggccgtttgaagtcagcaatgtagcaggtggccgaatcgaattccagcttatggaggacttgatcttgatgtcttcttgttgatccatgatgtgagcaatggttgtatccatagtagccatgttcacatcattctccccttcttcactgaaaaccgtcctcggtttttccatatggtgctcttcacacagtccattcaaaataacctgtttcatcaaatcaaaacaaggcaaactcgaaataattttgttagcaataacatttctctctagcttgcatgttttatccacatgtataggagattctaaatctgaacatatgtaaactctatgcaccaaatatagtcctctatcatcagattcgccaaatatatgaaaaatagcactagttggacaaggcaaatcaaacttagcaaataatttcttcttcaaattattgagctcacaaaaatcatcaaactgaacatagcccaaaatatttaaagaagatagcaattcacgttcctgtacttcattagcaatgtgaacaacatgcttaaaattggcacacaaagaaacactagaaatagcatgttcattcactagttgtgttagggatataagtgaagcattatcacacaactcttctttatcacaaggaatagtaagtaaatcaacttgtgacaaaggcaaatcagaagtagtttccaccaaaatttgttctagattagcatggatagtggacaaatgtgactcattagaagcacactcaccttgagtaatatcagcaccatttaatttaccttttatgccctcttcagataatgtaggtgcatcagtcttctcttcttccttcgtgagtgatggagatgacatctcgagcatattgctcttctcctcatggtgaatgttctgagctccctgcaaaatgtcagtaataggaggcacaagcatagattgtttctcccttgggtttattaaaatattgctctcaacactgcaagcaagcatgaacaagttgcctatatgattatatgtcacgttaataagcccagcctgaatattggaattaagccctctgaaaaatctagtcattgtgttctcattagattcttgtaaatcactataagtaatacaaattttaaaatcatgaaagtactccctaacagttttgtcaccttgttttagatgttcaaatttctcaaggaaagcacgtctatagtatgaaaacacaaatatttttctcatcagtattttgcattcatcccaagtttcaagcttatttcccacagtatgccaccaaaaagatgcagaaccggtacacttattactagcagccttaatcatttgagcattagaaaaatcatactcatcaaattgtttttctactgctagctcccaattaacataagcggcggaatcatacttaccatcaaaaccaggcaatttagattctacccttgcaagatcactatcatgtacctcatatgtgatgcgtgaagaagtcgctatatctcgttgatggtgaagatgttgacgttgagcatgaccatctcgtttccccatgcgcaatcctgccatggttagtagcaaataagaaacatacacaaaaatatgcgcgttcctattaactactaggtagtggcagctcaaaaatcacacacactcaagcttttaaccaagctcttacaagatcttaccaatgcaagcggaatggtgacatacaccgactcaaccaagcaccccaatggaggttggatgtatcgatgccttggcaaatacttgctgtacggctgcaatcaaatctgtggagctctaggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttcttttttttctttccttttcttttctgtttttttggtgcatcttttttttcttttcttttttttatgcacctttctgccttttttttctctcacttttttcttgattttttttaacaaaaactgactcaaggaccttaatgtaaggttacagggactcaaacgtaaatataaaatttatagggactcaaatgtaaaagttcaaaccaaaattaaaaattatacaaaaatggaatgctgaatttatactgattctgtttttctgaacggatcttgaaacggacaccaaacaaaaattcaccaaggtgtaagggatggcacggtgtagattgaaccgaaaggagaggggagtcggactcaaggggggaatgccgcatggaaggtggtgggactcggtgagaatttctgaaagaaggaaacctattccttttctgcgtggcccccaaatagaaacgaaagcaatctaatctagtctaatcttctccttccatcttcctcatgcgcatcttctccttccttcttcctcacgcgcacatgcacggcaaaaacaaacacacacaaggatcggcaaactctagatgcaacacaataactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgttaagaccagcaagatgacgtgacgatgcaacacaaaattcaacaaagcaaaaactgaaaagaactatgcaatggcacaatatggctaggtaaatgatacaatttctttttgtcgggctattttctggttatgggtagataaaaactcaccgagcaacgaaagctctgataccacctgatgcgaacccgctagggtttgtggcccgatctttcgatgagaggtaggggataactcgattggataaagacgacgttcacggcccgactacaaccgtccaaagacgctgcgccttagcaaccgatacactgtctccaatggtcgccgcgaacttgtggtgcgcgtcaacccggccacgagggcactcgtcctgcaagcaatcgaagaacaagcaagaacaagtagaacaagcactgaaattgctagataaagatgaaaatttcactatcaaaacacaatatggtgggggttctgattacaggaagacgagcggtttagccaacacgcgcgctgcgagccggtagcaagtagctatctctatcatcaaaacccgagaaaccctgaaggggtacctagctatttaaggatgtgggaggacgaccaacggtgccgtagggtcgttctccaccaggttggggcgcaccccacatgggccccacttgggccggggtcccagacgaagttacaagcccataggcccattacaggtgacgcaacatcttgtttctgcgattgccgtcgactaagatggaatctgagaacaagactggatccgttgaaaagaggacttggagggctttccatcaagtactcatggacccaaaacggagctcgtatgaaaatttggcggccgtttgaagtcagcaatgtagcaggtggccgaatcgaattccagcttttggaggacttgatcttgatgtcttcttgttgatccatgatgtgagcaatggttgtatccatagtagccatggtcacatcatatacggagggagttaatctacacagagttgctaaaccagaaatataattatgacagcttaggttgtttgactacgaccttattgttaagcttttgtttatacttatgtgaatcgcttatcaacagtttttaaataacttatgagtagaaattttatactgtatactactccctccatttcaaattgatctacatatatatttttaaggttattcctaaacgatatacatatttgtgttcattcattaagtctattcgttatctgtgcttggagtaaatggacattgatgcatgcatccatgcacacaagtatttataacccatatgcaatatctttatttgctattggctaggaaataatggggatggtgcatacattaagtctattcgttatctgtgcattggagtaaatagacattgatgcatgtatctatgcacacaagtatttataacccacatgcaatatatttatttgctatttgctaggaaataatgagtatggtgcatacatcgagtttgttgctagagtaaatatagtaggagagagttattattttttcttggtcttgatgtacttatgaaatatgtaaatcaatttggaatgcaggaaatatatctttagcgattcaaaagtttttaaataaactacaatgaaaacctataaaaccaattccaaaattaaattttacaattcaaaagttaatttataaatataagcataagctttgaaggaactatcacgccggcatgacatgcatgatgccgacagtccctgcattttcagcttcagtcacatctttgagtactccacttcattttttcagcttcaagctacttctagtactacttcagtacaaaacttttactgtcatagtgtcatgcaaatgtcaataagtgccaccatcacaatacatcaatgtaaagaaagactcatgatttttccctactcttcactccttaatttcaccttttctttttctcactttgagctttcaaagtattcaaaatacagtatcatgagggtcttcaaaagtcaggagaatccaatatgcatgcagcctttactgctagatttgggacacttgtcacagtctcaacgttacaacagtagtaaaaaaaaagttgcagtatcagctactagtaataatatctttttgctaaaaagccagggtgaagaaagttactgtttagagcaagtataatctatgagaaggcaaaatgctgagatggatgagagaggagaggatagagatgagaagcaggctgtaagtttagaaccggcttagacatagaaaccaagaaaatctgtgaaacagacatgtgaaacagacatgtggactattatattaaagagttaaccattatatgagtgagctgagagataggctataaatatctatacagtaaacaattggctgcattattatccgtcctacagatcgtatgtttgtcgtaagccaaattattttaaattaaattaaatttataaaaaaacaataatatttacgatatcaattgttatcatttggtccactatgaaatatatatttacagtctatttctttgatgagatatatgttattttttctaataaaaatttagttgcgcttagaatagtttgactcagacgaacctaatatcttttttatattttaagaatagagggaggagaagtaaaaaattcagagggaattgtcaaaagtttatgattacagttaagctagcttgttcaagcttagctgccgacacgatcatccagccggcagaaaaaaattgaaaaggaattgcaacttttgtagtatctctccttcaccactggactggagtcgtcaggtcacagcccaacagcttgttacaggcatatgctgagctacatgttctgaaatgacctctgcaaacgggtgaacctcgcagctgcactgcagtgcactcaactgcatctgaattctcttgcaaccactcaaattcagagtaaagaaaattctcatctgcagtgactgctctgactttatatgtgagattagtaattttgcaggccatgccgacatacacattggttgcttatctgatacctgtagaagctaagcagaacatgttcttgctgatgagttgcaggtgaagaggatcttatcctgtcaaatttgctgctggctcttatagatttggatggccatgatatcatcagctaatctttatttttctttaattagcttatactgtgaaaaattctgataggtaatgacagatatatatactcacatagcaaggatatctctttagcttgagtggtgtcatctcatgtttgccactgcaaataagccaataaaccataggctccaaaaggtattattctgctaggatatgatctaagattctaaggctctcttttatcatctcctaacagataaaaggaccataggtatttttacctccaattctatctatcaagaacaaggcctacaaatcatcaattgcatacttttattatggtcccaaactttatggatgcagcattacagctaaatgacatggaagaacatccaagatgcatagaaacgaattagcattgaagaggtgtgtgcaagaatctcaatggatgccaggctttttgatggcaatggctctatggtgcaatgctcctggtccaagtgcgtgcatatgattaggattgtgaggtgacattggcacctaatgtgttctccttggaagatagtacattgctgttgcaataccctacttatctgaatatatccccagtttatgctatgaaaattcagagtctgtgtttgataagtttggattgtgttcttgacatggacattgcaaagggaggttggccaagatctaattaaaaaattttgatcagctagtagaaaagtgaaggggaaaaacatacagcgcttggctaacttgtactgtactactcaggagcaatgtgggggtcacactgggcctgctctttgatgtctgatgctaggccctgtttagttcgcgaaatgaaaatttttaggtgtcacatcgaacgtttgactggatgtcggaagaggttttcggacacaaatgaaaaaactaatttcataactcacctggaaaccgcgagatgaatattttaagcctaattaatccatcattagcatatgtgggttactatagcacttatggctaatcatggactaattaggctcaaaagattcgtctcgcaattcccccctaactgtgcaattagtttttatttttattttttttaaatgcttcatgcatatgtccaaagattcgatgtgatatttttgggaaaaaaaatttggaaactaaacagggcgtaacagttttggtcagtttggacctactgaaagctattggaatcttctctgtgtgtgtgtgtgtgtgtgtttattttctttttctttctttctttttttttttttttgctcaagaggggaccaaaattgttgttgttgcaaaacctcataatccaagtagaaagtttctgatagagcaattcaatcagaaagttgtacttgcatcttgtgagatggcagaagccaaataggcagtgatacttcatttctgtcaggcaacagtataactctgattctagacaactttctggcatcaacttctgcaaacagtaacaaaactctaacaagaagctagagctaagctaactgatcaattattctgctaaatgattgttccagataatacactaactaagccctattcatgataaggctgaatgaaatcatcatccagctgcttgatactaccaaaaaaggagaaaaggatgtgttactctctgaacattcagatctctccaggttagcacaacttgccatctgaaaacagaaggccatgctgctactctacaatgcccagtttgcatctgctgtctgcttgatcagaagccatgtcttgtcccttgcaaatgcaactgctccttgatgcatgcatagcctccgatccaatagttgaagtcggtagccactgtgtacccatgcaaatggatggtgttgaggctatcagctattgcagaacatcaatctaaagacttccattttattatctggatactgcacttacacaatggaagtctgcaccagaggtgcactaatcactagaattattgcatgaactagagagcttattactactacataatgggatgatgtgatatgtgttccatatgaacaggtaatattcaggttcctgacaaatgtttgtgtggacctaaaatacagccaaatcttcagttaggctgattgatggctatgtggatcgccgtcgaatcttcaggtatccaaacttgcctgcacctggagatgagccctcgaaaacaattggtaggtacccggtagcagctttgtatctcttctgaatctgaaaacaaatgatattttgttagcatgcaataccatgaaaatgcaaacattatggtgaatcacaactctcttggagggtttatcttggatctttgtagttatggtcatccattgtgtacaactgacaataaaaaacgatgtcgaaaatacctcaaaaatctcttcactgcttttcaagcaatttttcccaatgacacaaaccgagcccccagatcctccaccagttatctttgcaccaaataaactaggaccaccatcctgtgaggtcttcctgtgctggacttcttgtaccatattaacaagcctgtcggttccatcagaaccaagcccacaagcattgtagctgtagtggcactgccagaaaacaaaagggtcaatgcagtgccactgactgctaattttgtgaatcaacatgtacagtgctgggctttcatttgtaatacagatacctgatacatcaattctccaagggccgaaagttgctcaactgttttggctgctgttagcaatgctttgaaggcctacacgtgagaagcataacaagtgtcaaaaatatcagtgaaaggaataagctattctttatggagaaaaaataaagctggttctgaaaaccatgcgctctcaagatagttttctgatttgcaaacatctcaaagaattattttaaagtttaaaaatacaaacaacgaggataaagcagcaaaagcagtagaacatcagacaacaacatgcagggatctcatcaacagccattatgaatcgagaggtgtagatattctggttttatgatatcaaacctcaactcggaagttctcgtatataggatgtctagtaggagccttcacacagtaagatcgttttgggtcaacagttgttactgcatcattatgatctccatacttctccaaaaatgcatccccggttatgatctctggaatatctctcgcgtaaacagcttcatatctgaaattttgccaaagtcataaaacctggcatacactatgaaggaccatataaaatttgctgtcaatatcaaggtaatgagacctatgaggtggtaggttgcataaatactccagcgacgcttcagatttcaaaagatctacaccatgttcttcgtattcatcagaatttgtgttgcctgattgaataggaggacaggagggtaatgattctgaaagaagatcagatgcagcacacttgatcatcttgcgtcccatgtaagtgcctacccttacagagccataatcagtcccaccaacactgcatgaaccaaagaagattatggttaactatgcatcccaacaataaaaccaaaccatgcatcccaacaataaaaccaatcttgcaaaagatatcaatatggaaagtatttacctatgtcgtatcccagagtcaagaccccaaaatcgaatgtgagttggaatgctgaccaactctttcacttctgcaggctgcagcaaaatttgatcaattaattatagaggaaatgcaaagttggactgaggaatgactgggtctggtagctacttcctccaagagctgggtacccttactaacctgacaaatcattgcaagaagtttgttagcttctccacaagcagatgtcatttgatccattacaccacaaggtgctccaacaatgcgattctcaacctgcatagtcaccaaagaatgactctctgcaatagaagacctaccacattctgaagctatatcccttcatttattagtactttaccttttggcagagtatggcaagatcccgtggagggatatttagacctgaagccaagacaagaacatgaattgatgtcaactagcacgcccagttaagttaaatgtgcaacagtggtggctgctgcagaactagatatccaaccaaaagaaagaaaatagtggcattattacaacaaagatgttcaagtcaatcgtttaccataggcagcagcaatagcagacatactggcaacctccactgatgcagaagaggagacacctttaccttcaggaactgatgaagaaacctgaggattcaaataaaattatcatgaatgaccaatacaaacattcgagttagaacacttgattgattagaatgtggaaggaaacacttgattgattagaatgtggaaggagaaagtgtgaaagatgctgttttctttttgtgactaataaacaatattccttttgagttctgaatatctctttatctccccaatatgagaaaggtgacaaactggacaaagaggtggaattttacatatattactgcattctgattgaaaacagaaaggatcaaagcttaccagaatgctcatgctgtctgtgaagaccacacctagctcggtcatcaacacaaggattgttccagcaacatatgcagcccatctgaaccagaaccaagaatgaatatgcatgacaagttatgatttttatagagtaaaacaaacgatctttcttacttttgggatgggtcctgagagaaatattctttggccttatcataggatattggtttgtcaccatccataaaatcagacaggtccatatcaaaggttggtgcacgattactcaattcagaaccaaatgatacctgtacagacatatttagtaagaagatcccagtcgtccaaatgagctgtgaagcatccaactaaatatatgctacatctttggttgtcaaatgaattaagttttaagaacgcataataaggataagaaaaggtaagcgaagatgcttagagagttagtgataaataacatacaatttgtaacaacggcactgctctgccatttgctagttgcctagcttgtgtatgcttccatagcttctgcttcataggattacttctctgaatagcaacatgacaagcctctcgaatgggcatctggtaatttggaccatctcaatgtcaatcgcatatgccaaaagaaactttctttatgttttaaatatatcaaatcaatcaataacttagtaacttacaaggagacataatatttattcatctatctaaaaataattgtaggaaggtctatagaacatgcatgtattcagagttttccaggtatatgtcaatatatcattccacaatacatgcaggaggaacccctaccttcaatggtatcaagaggagatgcaagcaaagttacagaaacaaactaaaatgatagtcaaatgcagaattgaagaatctttaaatattgaaaatttgaaatcatttgtgtgaaagttttatcacatagtggaattacaggaaggctcatctataagaaatgccactttctcttgcatttgaaactacctgtaatacaagacttcctgaataatctgcgatgccacccatgacatctaaacgtccaggtgctcttgcaacatatatttcctcctacaacagaataaatcattcgaaaatgattttcccctataacatatcaatagtttcccaaaaaaatcagtgtattatttttatgcttgtatagtacctcccaatcaaagaaaacagaagcagcaaccctctctcgagattgcttctcagggctccttggatcatttccaacaagtcctgataaactagttaaaaatgccattgtatcagttaatccttgtatgtccccatggagtatctcgaagtcctcaaaagatctgacaccaaaacaaaattatttgaatggacggggatatgataaagtgtgttattggataaagtacatgttattatgaggggaaaagaaaggatatggaaacttacgactctgcacttccattaacctcatgatatgttggtgctggacgaacaccgatttctttctcagacacagaataccagtcaggaattccgacatctctccctggagccctttgtagttgatatcctagcactatggcatcacgcaaacgtcttgctccgctcaactgtaattgtagagtagtgcaaatactaagtccagaagttgtgaaaaaaaaaactcttgtaactttaaaacttcataggttttcaagttccagagcagtagataaatcctctgttctgaattgggaattagcaactaggtggacagttccataaaaaaaatattcttgagcaaaagaattaataaaaacctccaggggtgaaatgattttaatgagtaacatgacaagaaaaggcagaagtgtttacttatgttcaacttatcactttatatgtgtagtatgaaagcaacaaaagttccatacgacaccaaatacagataactgaagatatcaaagtctcacttttatctgaaagtttcaaggtacaactgaacaataatgtatcaacaatttatgttagtaactcaccttgccagaaatatacttcttgccaacagcagtgtcctggaggatatgtgcagccacctgaacgaataattattagcttatcttgtattataaatgcaatcaagaaagtctgtgaatcacatctggtttgaggaaaacatgatgcaagtatccagttgactcttcatgacttacggaagaattgattcaggatgaacttcaacctatggctagtatggtatttcagttttaaaaatcagccatcataaaaaaaaaataaaatttacaagatggttactagcttgagttcccaaacaaccctcacagacccatatctgagaactgtaaggacattacctcaccaccatttattggaccatcatagcatggatgaagtgtcatagcacgttgcagataaggtttccagtgtccagtaagtaaatccctccgtaccatctcaacgccacattgataatgctgtttattaggaagaaaagaggatatagaacaggacatcaaggttcatgactgatgctctataagtacgaattcttaaaatgaaactatacttcgagatgtttcaacctcaagcatattcctcaaaaacggctcttcattgaaataatctctacgaacaaatacaaatggcagcttgtaagccaaagcctcactcacagtgccatatccaattttccctatgcaacaaccaacagaattgttacatttctagaaaagaaataaggcggtaaatagccctaacacagataatatagcactgtatttaccaagcatgcagtcagatgctgccatcaaatcaggtgtataggcgtcctttgcaagtttaatgaaatttggtggaagctcttgagtttcagatgcaccacatacctttatgaaaatagaatttggtcacaaatgttgtccagacattattaagagagagagaaagaagagagaagaaaacacgtagtttcaaagaaaatataccaaacagagccaaccatcaggcagccattctttcttcagtttccatcctgcaggctgaagaggaaaccatcacaatggcattgcatcagcaatacttgcataagatggtagcaaattcaactatggattgtactgactaccaataacagcagaaagacagaaaccttagctggtctaaaaggacatattgatttaacataaatatagccctttcaaaaaaaaatgatttaacagaaatatgcaactaacatccattaattgaacaaaatcgagcatctataaacgagaaagaacattcaggctatttaatggtttacctgtcctccaaagttgaaaatgaccaccttaacatcatctttaattcctaattccttcctcacctgatatatggagattttttaagtcatcaagaactgagaacatgggttgagtgttcagagcaaacattgtccagcagagttgtacgcacctcagatctagatttatgcaatcttctcaccacaagaggaacatcaatgacatcacggaaagcaggcactgcagaagatagaattaatcacgagtacttcaaaccaacatgcaggatctttggatatattattcattcagacatatagacgtactagggcagtatccagggagtcgtagtaagaattcacaatgtgaataatcttctgctatctgcagttgatgccaacataaatgcatggttattgaacgggctgaattagtctcaacttgcaactaaagaacgatattacagagaacagttttctcaaaaaaaaatcaagaaatttgaatccggtgtctaggtggctttaggaatttagtagttagcattagcaaaccaattagacaattttgcaccatttttgggaaatgaaatgacaggcacctgccacacaattgagcgatgatgatgtccagctactacgacatactctgcataaatgaagtcccagctgcaaatagaaggtgaaaattaaagaccgtgctttgattcaaaaataactactcaaaaaagaagcaagaaaaactgcaaataaaactatccatgtaaatttcttcaatagcccgaattataaaaataaatggagagaaaaaattatgtttacaactagtcaatttcgggtaaagccataactaaaatttattgttagcatcactcagagctgcagatttcttgtgggttagtagataacttttgtgttcagcgttagtactgattacatcaggaaatgaatgttagcaggcaaaacatataaaagtcaggtaactgtagcaactatgcactgatgaaacatataaccccaagcaaaatgttaacataaacttggaataatatgggaacccacaaaggctgtaactaataattctaaagctcactctacatcctcattgctccttttgacccctagcatgaagcaaccacagaaacactaacctgaaattggtgacgcacaccgatcgaatgccagcatccgcagccgccctgcacgcgacggggacgacatctgaaacctgaccaaagaccaacaacaccacatttgcttcagatgctgtaaagattcatggagaccccggataaaaacagattaaaaaaatcgagcaagtagttggtgttagcatcctcaggagcattaccactaggtcggccttgatcgtgttgagccattccacctcagtcctcagaatcgattcgcgtggcatcacggccgtctgatgatactgcattccgcaccacacaatcactcaatcagccacaaatccacaggcaaagcacagcacagcaagagcaagagtggtggatgttgtagcagtagcaggtagtagagtggagatattggagtatgtttctggaaccttctcgagggaggcgaggcgatcgacggtgagggcgtcggcctggacggcgccgcagtcgaggagcaccttgcggatgtggaggttgggcgagctgatctcggtggtgaagacgaactccggcgcgccggtgaccacgtgcacgtcgtgccccgccgcgatcaggtgcctcaccacctgcactaaccacaaaccaaaattccatcaccccaaataaaaattaaaaaaaaactcaaacagcagcgaatccatccatccagccacgaaaccaaaattccgcgcagaaaccaaaatttcatcgcacggagacaaacacgaatcaatcctccccaaaacgagaaaaaagagaagacgagacctcgagcgcgcgggtggcgtggccgaagccatggccggtgatgtagtacgcgaagaccagatgctgcggcggcgccgacaccaccgccatcgccgcctcctcctcatcacctccgccgtctccccgaatcctcatcgccgccgccgccccaaatctcccggaatttctcccggaacaacaaaaatcgacacttattatcagagactccacactccacactcctcctctcctctccctcttatataagtcagacgatcagcaattgattgattgggagacgagacgacgtggactcgttggttggtgttatccgaattaacgaactgccacgcctgaatttcttttgttgttttttttttgggttttttttgttgttggcgcgatgatttgttggtggtggatggtggtggtggctgccattcccgcgaatctctctatctcttggtgtcattgccgcgattcgcatggtgcctgcagaatcagggcgcaacaaaagagcagatggaagaagcaacagcaagtagtagctgggggagttaggtttttatcctatccaattccagtagcagccaggacgattcgcgtatatcctatccaattgttggattatgaatttatatccgattcgttgtccaactagtccaacctcctctgcaattgatcaaacaaaattaacctgtaaaggttaattggataggataaccttttacttaattggttaatactactagattttaaagtagaggctagaataaattctacgattggaaaaattcttatgctttctaccttttgtaggctttctatcatttagggaaggtttttttataattaagtaaagtgttaatagtgttaataaattaaccctttagttaatttgataacattcttttgataataaattatattataacaaaaaaatgctaattttatagtgcttcttaacggtttcctggaggtaacacattttctatgcctccggttacactaataattttgtatctttagttacatctcaagaactgtaaaattttgccaaaaagtatcatgcttagttactccctcttttactaaatgtttgacgccgttaactattttaaatatgtttgaccgttcgtcttattcaaaaaatttaagtaattattattttttcctatcatttgatttattgttaaatatacttttatgtatacatatagttttacatatttcacaaaagtttttgaataagacaaatggttaaacatgtttaaaaaagtcaacggcgtcaaaaattttgggatggagggagtatttggttaataactaaacataatataaaatgtggataaggataattaacgttgtagaggtatttagcatggcatgagcatgcatgtagatgactgaagatcataaggctataacaaaattggcatttttcaaaccaaactcaaggaagccatgaacatgttatgacatccttcaatttgacaccaaaactcaaaaagaaaggatcttgagaccaagacggaacatataacatcagtccaagtcatcaactcaacccatcgaaggggttgcgtctacgccatgaccttgacgtccatgaccagaacatggcatcgtgtaccgcttgtccctctgcttaatttggcacttttgagttttgacttcgatcaagggatttttttttctctctatgaattctattaacctctaattttttaataaacgacgacgttaacttttggacgcatattttagcatctgtcgtcatactttaaactggagtgagcaataatcaattccgttatcaactatgcaattttagaaaactgcaattttaatgacaaaaccaacattagcgacatgttttagtttactacaacaatagcgtgagaaattatcacaaaactgtaatttttacgttatatgctgctacagttgttacctatatgtactgtaacagcatatataacataaaagttacagttttgtgataattttccatgttattgttgcagcaaattgaaacatgtcgttcatgttgcagcaaactgatagttatggcactaaagttacagttttttaaatttactcatggatatattatcagcaatggttcagttggtcacaaactcacaatcgcaagatcacaaatgcagccagcagcaagtccaaacgcacaacaacaacaacgtcggctgctgcaaacctgtctgcaacgtcgctcagctcagaacacccagtgcagcgtctcgtcgtcgtccttcctcggccggccgcgccgccagctgctgcgtcgtctggcctcgcgcgtgacgaccgtctcggtggagagcacgtaccgcctcacggcgcgcctcgccatgcgcagcggcgccttgccgctcgccgacgcctccacctccactccggtcaccaccgcgaacctctccctcacctccgtctcctcctcctcctcctcgccggcggtggcggcggcattgaatccccagcgccgcgtcgtcgtcttcaatgaagccttcttgttggtatcgagtggtcgtcctcccacctcgacgcgcgtcgtctcgaacagctcggcgacgcacagcctgccgccaccgagctggacgaggtaggacgccaccggggccggccaatccttgtgcggcgggcggtacctccatgtgtggcgcagcgacgggggcgtggcggtgaggtcggaggcgcagaggtggccgtcgtggtgaggggagaagccgaaccagaggctgtgctccgggacgtgctcggcgcggccgcggaacgggagcgcccagtcgccggccttggaccacgcgccgctcgccgtgtcgaaggtgaacgtcccgtgccgctccgtggacacccagatttgggagtcgcggaccaccgcgtgggcggcgacgcgggcgggcccgtcgtcgccgtcggggtcgagaacgtagggcggcgccgtgagggagcgccagtgccagtcctcgatgatggtggcgccaccccgcggcggcgccggcgggaggccgtggacgagcgcctcgaagcagtgctccgccccgcgcatccgcgccggctccggcgccgccgcctccatgacgtagacgccgtcgccgacggtgaaggcgatggggcaccgcttggtcgcgcgcatgtgggggaggaggcggacggcgtgggcgccgcacttgaacaggatcagcaggaagctgcggtactcgccgtccacaccgaccaccttgtccttgccgccacctaggatcatcgcaccgcacctgccccagccgtggccctggggtctatagatggcctcgccggcgcgaggtagctgcgcgtccaccatcgctgccgccaccggcgccaggcgcgggcgatctgcggcggctgatccgtcgcccccgccggttggctttctcggcgggaagaagcgcgacatgtcgatgcggcggagcccgaactcctcgctgccccacggtgtgggtttcttcaccagcagatgcagaaaccggcggctcatcctacaactaccgatgaatttctcgacggcggcagcggcagcggcggcggggggcggcggtttcttcctttggccgtaccggttaaacccctagcttttcgcgcgtccgattttgtactgataacctaaaagatatccccttgtttggacaaaggtatcctaacagattggctgtgtttagttcacgctaaaattgaaagtttggttaaaattgaaacgatgtgacggaaaagttggaagtttatgtgagtaagaaagttttgatgtgacgaaaaagtttgaagtttagaaaaaaactttgaaactaaacaaggccgtagtttgagtaaaatttctcaaatttctgtttgaaatctacaggatacaaatatgtgcaatacaacataagaaaaggaacatatcaagaagatcacaaatgcggaagaggcgaagagcattgaggtggtaaatccaaaatgctagataaattaattggatgccaacatacaggcttgtgttttttgtaacaacaacagtgtacactctctactaaaacactaataatgggcaagatcaggactatttctaggtgtacactgaaacactgaatgggcaagatcagcactatgctagagggagctactatgcacataacaatcattttaccaattgatctaatgatcagcactatgcaccacatggcagccatttgaggtactagtcgtggatgctaactaactggaggatttcttcatccttcctgtaagtaaacagcagcagtcaattcacaacaatgacatctgaccgtcaccttgaccacataacaggtgctgaagggtttggtagcgacgatggggtcatgcagtgttgttgccactggtgaaggctttcgccatcgattgctgcgacatttgcttccggagattcctcaacgtccatagaatcgacttctgtctcatcagactccattggcacttcgaagaattctctcttttctgaatctgaagcagaccaattagataccgtggcaatttgtggtggtgtccaaggaactaaagccaagaagttgctgcacccaggagatttgtcctccagcccgtgaaagttcctttgcataaaagcctgatctgaaagatgagaaagaaaatggtgaggagcaatttcaaggtatggatgataatcctatcctgacatacaggacatgagtataacactagaaaatacatacacataaagtccggtgcgccatacaaacatgctaaagtagttcagcgggctttcttccttaaagttaatcatctaatgctcatcacttaaaacagaactcacacaaagaatgtcaccaagtataagtgtgctagaagtacagaggcattttaagacaaaagcaaatataaaatcaggagcaacgcgtgcagctaacaaacttgcatgctagcaacatagccttgaatatttgttctactactagccagttgccacaaaactaaacagtgagatctttgcaagataagttctgtgtatacttatttcaatatcaaccttggatgcatcacagatgtagtatgtaaaacactaaaacgcctaacacctaaagtagcaatagcatcttctcctatatatctatcccatttgacacacgctcgacatactgtaaaagtacaaaataaagtattgcaaacattcaaatattcagaagaatacaagagtaagttataataatacaaaatgttaagtaacttactctttagactacgtatcaagtctggactgattatgattgaagggttcgaggtcccaggaccaatgcatgcagtgttatctactgacttgtataaaacaagtgccttgtcctcacttgatggatgagattccatggcacctcccagcatgtcttctataatgggcatgctaacaacactgtggatttcctctcctagcatctcatgtccaaatggcatggaaggacctggcgtctcttcttccataataggtggaagcccaatatcctacaaacaatagtcgacatttattcagcaaaatgtgacggtgcagcaaatttattgaatatgtacttacagggaaagtaaaatattgaaaaccaaacaaatgctagaaacgatataatgcgcatttatatcctgaagcaactagccaactacaaatgaaacctagttttcttcaagcataacactcctactggttagtggtaacattgaatgaggtatcagaaccaaggtgaaatatggcaatacattgctcagtactgagaatatctcccactagaacactgagtggggatggtgatgtcataacaaaatcatgcatgccacgcccacaccaatggtggacatcttattaacaatgaaagaaaacaatgtcaagatgataaaaaaaaaagaaaagaagagatgatccattgaagtacagtgaaccacaagaaaggtttgctagtggttccatacagattttgacgaacagaaagatagagtcatttcattattaattaggaaccctctgtgataactgttactgctgagcaaactcatattggataatgctacaatgataaatttggagaggatttatggtgctgataaagcctatataatgctccctccaatcaaaattatagaactaagtttagttctccgaacgtcaaatattttgactggagggagtatctaaattataatccattgaacaactacatgaaagatagtttagggaaacagctggtactcaaatacatagtagtattagctatgctttcactcagctattttatttcgttgggaatccgttgttttctaaactccatcatgcgacacacagatgtaaccaagcaactccaaggtactgacaagcaagaaaatgaaatccggtaaacaaacatactgcaataacacggtagattcttggatgggaacagttgtcatggtaagcccaagatgacactttctcagtgcatttaccatttttttctcagcctctcttaataatctcattgcaaacacggcacccgcgcaaaatcagggcatccataagcatcccgaaatacaacctaaaaatgcaccaaactacctggtagatatcgcataatagtactccaactaacattaaaccaagcaagctcataacatgcatcaaactgctactagtaaccagtgggacgcctaatcatagctataaaagtaaaaaaaaaaaaatatgattccaggctccaagcatgaactacaatagaaatatccgacttagagccaagcacaaagctatgaaatctaacactcgtatcgaaacagtactagagcatgggggaagacagctcggctgctcagctacacagaccaaacgaagccgtagggacgaggagagcaaatggcggtggcgggagctcaccaatctgcggctcttggcggcggggccggagagggagaagtcggagaggccgtccaccacctggtccagctccttcctcttccccatgaaccccaccatcatccggcttcccccaagggaaatcaatcgtgctcgaatcccgcgggctcctcgcgagtcccgagctcgaatcgaggcgcggggatgctgggaatctgggactgggctgtggtgggattgccggccggcgggcggcggcgcggggagcggcgggtttcgcgggatcttggcagatggaaggggtggggtttcgcgtgtccgcgtggggtaattttgcgtgggtgggtgggtggtgcctcgcaccggatggatggttccagaagacgggtggggtcgtcaatggaaatcatccaattggattggtcttagggcattaacaatacgtcacactagttgagttgaggagcctcggggtgtcacataggatagggctagaggtctaaaatttggattcttcacggtgcaagtgtctctaggagtttatatttcagcccctaacattttttttagttcttatagtttctttaatttatgtgaagttccaaaatttacactatacaccctacaatctctactattataaaaattaaagatgtttttgttggtactttggtacatcatccgtgtatgagttgatttttaatttcgttcgtttttgaaaatacatatccgtatttgtgtcggtttttaagttcgtttgcttttggaaatacagaaaagacttctaattgtagctcatgattttcttaaaaaaaatatatttatccaagcgaatttctacagtaaatttcatcttaactaaaccatatctctactattataaaaattgaagatgtttttaccagaattttagtacgtcatccgtgtttgaatcggctttaattttatgtttcggttttaatctatatctctactaaaaacaataaattctggtcttatgttaaaaaaagaaagaaataaagtccaacttaacgagcgataaaaaaaacttccgtcgttagtaaaaaaaaaagcatctcgtcgcttgaaaaaattgtccgactcctgtagaaaaggaaaaaaaatctcccagtaaaaaaaaagtccgtttggtttttttcactggtattttttttccctttttatgtttggctgggtcaaagaaaagcagaccgaatggaggaaggtagcggacacggaatagcggactagtctagggctgaaaaggaaggaaggctttcggccgaaaacacagaaaatatttttattaacctttttaattattatctatagcgatcccaatgttaagatttttattaacttttcaattatagtgtatagtaatcctgatattttttattggtatgaaatcttaggtaatcccgattttttgaaatcttaggtatgacaatctgaaaatttattggtgcttgttttgatataaaatctgaagttgcaatgttgtttgttcagaaatctcaaaaacgttatagtactagttctgaagctgataatatgacaagttttacagtgagttcttgaatgaactagctgataattgaccagagactatttggctacatgtttaataactttaaacttggttagtttcaagaaattgtagcagtgaatgtagcacgttctgaaaattttacctcggtgctgtattttgcttctgacggatataaaatttcactgtattagattcatggcaactagtcaagtactgaactatcgtgtacatgtaatggatgttagatttaattgggtaattaatccatttaaatcaattaaatcaaataaatttcaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccatgactcttactcttcatcttccattcctcttataaaatgagaatggatttgatctcccgcgagaagaagtagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaattctattgtaaatatcatgtttattatcttgttattttggattaaaatatgccgaattatgaccaaatttccaacaatggatacatatccaggtttctaaaactactagtaaaatgtaattggttctgttgtgctttcatacattttccgattccaagttactattggcatgtgtgaatgcataaaagaaataacttgctgttgtttgttgttcatgtgaaaatggatggaagtgtaaaaatatacaaaagctcttctgttcattgcaggtgatcatttgatatgctaccccggtgcatttaacatgactacagggccattgcactgggagttgctgcaaagagcaaggtattacattttctaaatcatttgcacctgaaaatattacgatcattcaacgaataaatatgagcttaagggacaaataagagacaatgaattggactggtaatgaatttctaaaataaactcaaatgtacagacaacttaagcttggttagtttcaagaaattgtagcagtgaatgtagtgtatgtagtatgcacattgtgtacagtagcatatacttctctatatgataaagttgatcctgtacttttccatgtgttatggtgaattggtggtgatgttgtgaggtgatccatgcatatattatggtgatggcagaagattctacaataaacaaatttgattttcctgcaacttgtaaattcgcagagagatagggcgaggagtttgaaagaaatattatggcggtcaaagaaacacctgatgaagcacagaagcttgaagagttcttatgcgtacgaagagaaatgctgaaacgtgtttaactggtgaatatgtcgtctgttgctttgccgtgtaaaaaccgttttatcctggcacttgtctgcagggtgcctgttctactaggacaatgaggcacctgttttgatagctctcttttcatattgttcatgctgtaaaaaatgggtgcaactgtttatggagaaaaaagtgggggatgcgaatcatactttgttgtgggaggatgtgtggtatgggcaaactcctgttagagtgcaatacccaggcctgtatggggtcagtttacagtgtgggaagactgttaggcaggtctgagacgggggggggggggggaatgggatctaaagtttttagaagacatttgtgtggggggagtttgttggagctgcaagatcttcagaataagttgagggctgttgacatcacttcagactgtgataggatcatttggcctgctaggaggaagcgggagtacaatactaggtccatgtatctctactacttaaaaagtccgtagtggtggtcttgattcctgacatagcagacgcatcttacagacatgcataatctcaaccatccgattgccatatccaatagcgtcaatctcctccacatcacgcgatcgctcctctcccatcacgcgctcgctcctccccatgcccactcctttccccacgccgcgtccttcgccctcctccctgcgtcgcctcctcgccccgccgtcgcgtcgcctcctcaccagccatgcccaccggcctcctctccagacccccgccgccctctccaatctccacgcctccacctcgcatcggatcaatcctccaccttcgccctcctccctcctttccctcccacacggaaaagtctatacgtactaaatttttcttacaaaatgtttacaaactctgatgtgtcaagctgtgagtaaatctagatttcttgtaacttccatctagttaaatcaaatggttgagaaatttgttagtaaaagttttgtaagaaaattttagtacgtgtagcagtactcctcccacacacacgactcgcgccaccaccggcccctcaaccccgccaccgcttcttcccttccgctcctttccctcccccacccaccggcgccgctaccgatcccgccgccgcactaatctctctcgccaccgtcgcccgccatctccttactccgcaggccttcggcacgccgcagacgatttccacgccgaccggtcaccaccgacgccgtcttctccctacttcaccgcaggtactgcttcattgcttccgctcccaccttccccttctctgatcttttatgtcgctcccaccttcctcttctctgatcttttatgttttatgtggtagcttgtggtagctaggtcttttatctatactttccctgcttcttcttcttcttgttgtgtttttgttgctggatgagtggattgatcaaaacgtatgtcctcatccgagagaatcaacaaaaaatcatataggcatcatttatgtttttccatttccactttttttcactaagtaaattaaagaaatagtaagtttgcagtagtgtccgagttgtgaatttactaatgaaaacatccaaactgaacgaagtttgttttgctgtggcccttattattgcatgtagaaggccagcggtattttatttttaaaactctctcgctaatttggtttcatttcatttaggtagatactgattaaatttttaccaaagcaaaattacctctatgttctcaaatagaccgatcttgataattatgggataatttttgtgagattattctctctattctcatatataatgatttccatattgtttaacaaagattatgttcgatcatataaaactttgtatccctttaccgaggaatgataggagttgagaaaatagtttagagtcagataaaaagaaatttgaatgggaggtgagattgaaggtaagttattctataaatccttatatttttttaataaattctaaacatttgcaatgcttatatttgtagatagagagtagctacctttatgttattttaaagggattaaggagagggcaataaagttaaatggcagggttgtgttttatttttgtttttgatagaaaatgttaaggttatgattgattgagataaagaagcatatgaagaaattaaatagaaaatggtagtagttggttgagatgaaggaatatgtaaagtacgctaaattttatatattaaaggtatttatattttgagatgaagggagtaataaaattggcactacgatggatggagttcttaaatagaaaatggttgtagttggttgagatgaaggaatatgtaaagtacgctaaattttatatattaaagttatttatattttgagatgaagggagtaataaaattggcactacgagggatggagttctatcgttgcgggtcactgagacgagctgctggtactctccatctatatttatatattgtgtagtagtattatgtttatgaaaaaatatgtattttatttgagtaggctattttgtctaggaacatatgagttctctgccaaagggcattttgtctggaagcttcatgattgatctaatggatttcgctgtcattcatgattctcctgtgatccaacggtctatatatttttaccaattgaatctgatggtccttgcaattttaatttaatgaaaccgttccatttgtgggatattctattcgtagactgtaaagaacagttgcataagtaatcttaaaatgaactttgataaatattctacttatttcaaatgcagttattacattcagttgataattgtttataatggtcgatttgctcgcatacattatttaatacctgtatatttcagaatattccaactattgaggcggacgcaggttgacaactgatctaattaagcaatacaggatccttgcgtgtaagtatcatatgctcacagcccttttaatatagtacgaaattggggatgatcagacctttgtgttgaatttaaagattcctggacagttttaaagtatcttattctgtttgaggattcaaaatttggattgctcaggtgttgtatgtacatatttgtagtatgaaagaatgcgatttcctactttgatcactaaggaaatcgggcacactacaagactgagagtctaagtcacatgaatttgtagattaactgttgcggatttacatttttggtagaaaaaaatctcaaatttgccttttgcattccatctggcactaacttagcctgctactctagcaaaacttacgatcattctaccgttaaacttacaatctgaccaaaatacactgggtgcataatcctcagattttcttccaatttccaagttaagattgtttgttctgacagtttcatccatccagctaatgttatattcatcggtcaattgatatattattgcttgctaattttacaatcactcctctctcaggtccttttgctgatataactaatgtaattgatgctaatttgacgaacaaccatcccgctattaataaaaatggaactaatatgccaaaagatcatgagaattgtcaacacaacaacttggactctataggttgggcgtagcaccatattatatatttcgtttctttttaagccttttgtattaagcacagtttttgtgtgcaggcactcttgaagatgttacaaaactaagtgcggctgaactaaaaaggaagcgtgctagggagtggtacgcatcattggccaaagatcaaaagaaagatagaaacaagaaggcacgtgatatcaggaagcggaggaactatgaatctcaaaggtttaagggggtgtttagatggggctaaaactttttagcccatgtcacatcggatgtttggacgctaatttggagtattaaacatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaaattagtatccaaacatccgatgtgacatggatttggaataagtccctggaaaccaaacgggccctaaatctctactgttgtgttgccttctgcttcaccgtgacaagctctgttagatgtgatgggtaccacctataggggctctgctacagcgatggttcttcttgctcattgtccaatcctctttcaaattgccctcttgatcaggtaattaggtactgtactatcttaactaatcgatttgcttttatctatgctttccttcatctggttttgcttctgtttaaaggtgtgagtaattgaactgatgaactttgcccttgttttcctcgtccactgttcatgatgtgttggaattgtaacattttcattttatttcacattgacagcatgaaactaactttctactggattccacttgtggtgtcagtgggagaagatatatgcttaggacttcattgagattaatctagaagatatatttggactacaccatatgtttacgtgcagctgtcatgtatggtgacctttaatttggatttatttatgatatctttagttcttagccgtgaaagacattatggtatgtttatttgctgtaaaaaaaggcaattatttgtgaagtgtaaagttaagtttggacactttatgcaattatctgtgtagcacatgcacatacctgtttgtgtttttacatctatgcacatgcaatacaccgaaatactttgatacaattttgttgagggtgatgcattggttcagaaattcaattctggccgtgtgcaggaattagagataatctatatatgaacttgcagtcgtagaggtacactgaccaaacaaattgttattgaagagaaaaaaatatctaaggtttcactgaatatttcaaacgaattgtatattctagagtaaattccctgtgtgaaaactcactcaatactttctttagctaatcccttctatacccttgaaatttcaacttgatcccttccatgcccctaccgttacattttccatcatttcactattacgtttagttacaaatgaccttttttcccttgatgctttaggtttgaatataaccttcaaaaacaattaaaaattttgtttgagtgcgcagtatgtgcattttatgaaactaatgagactaaataattagtgcagaaaattttgacataaattttgaaaataaaacaaaagtaataaattgaagtttttatttgaaattttaataggacaatggattttttttatcgggagcattcataaaaccattattgtgaacattggtcctatatttgtatgaatgctcctcattttttatgattttttttaaaaataaatacatattttttatttcattatataaaaataattttggggataaataatacatcgcacaacaaactcataactattaatagtctcatgcgggaaacttttatatttttaataatgtaattcataaatttatatattcatccgaagggtaaaatggtcatttttatagaaattagacggtcaactaacggtcaactgacgggaggggtatagaagggatcaaaatcaaattttaggtgtatacaaggaagtaagtgaaattcaggggtatagaagggattagcttaatttccaggggtatacaagggattttctctatattctaagcctccatgcgagataagagttaacgatcttgtgacctactttttgcgagcacttcttggatgccctaatattatgtttgcttagtgcctttaaggagaaccgaagcaatgctaggctcagtgtgtggcgtgttgtagcatatagagatgtgttcgtaccacggaaatgataagacattttaaggatgttttttattaatcaaataataaatctactatttatatattttgcctacatttattttcttgaatatataatttataatttagaggcaatggtaagtcatatatatgtttcttgatatcattcatctgtcatgtatgcttctatgtaaatgtcacaggcatgctactactagtagattgttaagttttggaggggttattgatgcagaaatgcaggatgtgtggcaaagtaaagtgcctcttaagattaaacactttgtcttcttagctttaagagggagaattccttcaccctatttttttagggtttgcagttttaccctcacgttttgaaatctgaagcagccgtctaccctcacttgtgacaaccgtttggtgggtcccatgttgtgcgttaaagaaatactaaaggaaataaaaaaaaggttttaggaattgtgatattacctttgtacccttgagggaatggatatggttgaccagttgagtgagtctcccaccccgtgcgtcactttgcaggccgggggcgccggcggctgcggcaagggcggcgagggcggcgcggcgcggaggtggcggccgtgggcgcgcacgaggcggcggcggcgagggcgtgcgacgcggtggcggcgacgagtgcgcgcgcgcggcgcggaggcggcggccatgggcgcacgcgcgaggcggcgtcggcggacgcgagcgtgccgtgcgcgaggcggcggcggctgcgggcgcgccgtgcgcgagcggccgagggcgtgcgccggcgcccgctcccaggaggtgcacagccgtgctggcggcggcggctgccgcgtagagatttgctgtttcaatttgatgagcaaaatggctttgtatcgacatagtttcagaaatggatcgctaaatgttacttggtatttggtattttgttgatatgcacatgcttgagaatatgcacaaagggcgcacattatatgatttatacaccagttgatcctcttctgttcgttgcagtgaaggtacgttgattgttcttcaacttgttgagacattccaagctaaacttaagacattgtgcctgaaaacatacgccctttgtgcattataaagatggtgagtgacaaaataggggcaaaatcacacaaagctgaaaacaatagggcaaaaatgcaataaccatcgagggtataaatgtccttttctctacaactaacaccgttagaataggctgttagaagtggggtacacagctgctttagattaaaaaagtaaggaaaaaactgcagaccctaaaaaaaagtaagggtaaaacagtaattgactttgaaagtgggggccactgatgcaattgcccaagaagaaatgggatggcgcggggggagggggggttgatgaattagagtctgtgggcttggatttggttcctgggaatttggggatgctttgcacttgctaaaaagaaattgggaagggtcttgggcgtgtttgtagttgcggtgtgtatttggacgatttggctcactaggcgtgtatttggacgatttggcttactaggaatgactgggtttttgaaaacattttggtcaaatctcctttgcaggtggtgtacaaggttgttgctatgatgcaaagatggaaagagttgctaaaggagggcgatcgagggcaagtcgataagtggaaggaagtgatcctggagaatttggcgcgacttaggcagctgtgtgatcctcctgaagacatctgatttcggttttttttttttttttttggggggggggggggggggggtgggcgccgggtgcttaggggttccggtttctgaggccttgctatctatgtgttagtggtattttgttcgcttgatatgtagctggagtcccctgccatctagtttcctcgtttttccttttgtttcttgatgactgagctctttagactcagaagactgtgttctccttttggcttggttttcaagctgggtaatgaattacctgatctcaaaaaaaatattgttcttcgacaaatataagtgatgcctattactagtactttttttggcattcaagggtataattttgaagcatgctatagcatcaggattacggattactttctttacttaactcatgcacttttttttcctgttttattaaccagcttcgaggaaaaagcattttgcaacagagaattaccatgcacaagctgctcttgatcattgcaattttgcaacctccatgtttggcataagcagagcagagcgacataaaaaaatcactggcctattatattctctattttacgcgtgaaaacaaaaaccactcgggttactattatttaaataaatcaaactttggtgtactatatcacagaatatattatagcagaacgttttttttaaaaaaaaattaagtccgggtgtccggaccagatcgaatataaaaaacctcgtggtttttcggacaagcgtgtataggaataaatgacaaatattattttaggacacaattggttaagcccggaatccgtccggtctacccggactaggtcgaatataaataatcattgtttttctgtcgagcgcgcatatattatagcagaacagttttttttttaaaaaagattaagtctaggtgtgtccggaccatgtcgaatataaaaaacctcgcggtttttcagtcgagcgtgcatagaataaatgacaaatattattttaggacacaaatggttaagcccggaatccgtccgatctactcggaccaggtcgaatataaaaaaatcatggtttttgtgtcgagcgcgcatacattatagcaaaacggtttttttgggacaaaaaagattaagtccgagtgtgtccagacctgatcgaatataaaaagcatcatggtttttttgtcgagcgcacatagaataaaggacaaatattattttaggacgcaattggttaagcccggaatccgtccggtctacctggaccaggtcgaatataaaaattcgtggtttttctgtcaagcgtgcatatattatagcagaacggttttttagtgttcgaatgtaatttgttggaactttttaaaaaacatggtttttcggtcgactgcgcatagaataaagtggaacggattattttggacaactagttattatgaagccatgatcaggtcgattttaaaaaataaagcagaacagattattttcgggaactagttattatcaagccccgaccgagtcgattttaaaaaataaagcggaacggattattttggacaaataactatatgtacagaccaggtcaatttttaaaaaacatagatttccggtccaccgtgcgtagaattaagcggaacatattattttcgacaaataactattaagaccgggattgtccgagccaggtcgattttttaaaaaaacatagttttccggtcgaccgcggatggaataaaagacaaatactatttatactattttaggatataatgtcgaatattaaaaacctcacgatttttttagtgtccgaacctaatttaatagtgaatctctgaaaatatccacgtatattctcagcaagtacagcccataaagaaatttggaggccatctacgaacgagtgggcctgtatcgagaggcccatcagccgaagcgctatttggcagcacaatctggaatccatgcgcaattacataatacacccccctaaaaactgaacttacaagaataccatatgattttttttccacaattactcttttactacactactactccatccgtcaaaaaaaaaacctttgagggatgtgattcagtttatctcttttttgacagagggagtacacatttatattaggtgtagtagcaacgaattttcacccttatatctcatctcttcaatggtctatattcatttagaggtacactaaaaaaaatccatttaacaatggactcagttgttgtttccaagtgtgaattaagttacgtctaaccaacaaagacacacacgtgttgaatgtggtgttcaatgtaaagtaatttcttctacaggatgtactatgagttaacattttaagtagaagtagaacattaattcttacaaaataaattggatgttgatcttcttattataactggagtgcaaccttatctgtgtgctactcccgcgccgcctcttcccccaccgcatctgctgccgccgctgccttccccggtcgttccaagccatggcatcgacggcctccctcaacgccaagtcgcatcaatgccagtgctcgtttcttgaggtgagcgcattccttctcgttcttaattgaaccgaaaataggcatcaagatatataagttgctgcactaatctgcaagtttctgtcagaaaacatagcaatgcatttagagcttgattttagttagcaacttagcattatatgtgaaaatgcatttagagcttgagtttaattagcaacttagcattatatgtgaaaaaaattagcagttatataagatatatgattgtaaaaactacagcggctgccggtagggatttttggtggtaagtattgatttgacaattttggatttttggggctgatttttagtaattagattcaggttttaccaaattattcaggtctcctacatcactgctcactcctatgcatcctatgcggctgttgctactgtctgccaagatgagttgaatcatctcgctgcacttggtggtgatgatgctatcagatgctatctccatattttaatgtatgatactgttgactttttatccaacgtttgactattcgtcttattcaaaaaatttatgtaattatcatttattttattgtaacttgatttatcattaaacatttttttaagcatgacataaatattttcatatttgcacaaaatttttgaataaaacgaatagtcaaacgttcgtcaaaaaagtcaataacgtcatacattaaaatacggagggagtacatgccatggaccaccgttgtttcttgaaatcttcgttaattatatcagggtatccagagcaaagcacggttgaggtaaatacaatttcttggatcacagtttatctgaacaattaaccactcttgatgtacatgtcacatgttgaaaaggtttccagtgcgtattctgaacttatgttagcaaaaaagctactattttgccaccaccattttgatttatgtttagatagttaaactctgatatcatcatcctagagatgtacttgaggtgagcacttgccatctcgttcttaattgaacttaaaatatgcatcaagatgtgtacttgcagataacgatgccttagctgcacaaatatgcaagtttccttcagaaaacatacaagggcatttggagcttgaatttagtttgatatacgaaaaaatgttagcagttatctaagcttgaatttggtttttcttagttacgacagaagatgaacatagaaagatttgcatcgtcctaatatttgtttactactttactgcttccacctggtctattgcgttgtactagtaattaattttttcgaactctgacatagtgcagtgagaatgactctaaagaagcaaatgaagtaatagtaataggggaacttcttttgcgcatcaggaattagaagcaaatgaagtaatagatagacaacctcctgaggtagtgcgtaaaaatataaggtgtatataggtccttgctgtgccgttgaattcaacaactttttgttgtacgtgtaactaccacgtgaaaactacaatgatatgaagattataaagatgtgatgcaattatcgtttgtgcttcaaggttttcgttatagcagatttatattgaattattattttatatcacattatccagtgattcaaattgatgtacaatttttcccgttgcaacgcacggacgtccagctagtagtgactaactgtcgttcagataagaattgcatcatcatgaaagaaatagtatacagagctttcgaatgcagagcttttaatcgaaagctaaccgataagtctgcatcctgcaaaaacaggatgattaacagaagagaggtttattgaacaaatcctaagcagtggagtactccctccatcctataaaaaaccaacctaatactgaatgtgacatatactagtactacgaatctgaacatatctttgtccaaatttattataatagaatgttacatacagtcgtagattcaattttttcagtgggacagagggagtactctgctagtcagagtaggaggtttattgaacaaatcctaagcagtggagtactccctccgtctaaaaaaaaagacaaaccctgggtttccatgtccaatgtttgactgtccgtcttaaatgaaaattttttataattagtattttcattgttgttagatgataaaacatgattaatactttatgcatgacttgtctttttaatttttttcataactagcaatagtgcccgtgcgttgcaacgggaaaaacaccgtttgataatgtgacactttgaaaacctcaaatctgtaaaaatcaagtctaatttgatatattaacaaataggtagaaccgagtctaatttgatcaattagcataggatttaggatttagttttagatttatttttcgagcctacttaggagtttatctgacggactttaatttgaaaaatgtaagccacattgtttgatcaaatttgcttttggcctaggtcttcccaagccggtccaaacttgggctggcccatctttagcgagttgagtcaattcaacggcccgcaagctgagcagctaagtgcggcccacatatgcgggggcggtccgatgcacttccgcggcccattgggcgcagcgtaatcaacggcagcgacggcccgtcgctgggcgaatctgagccgtccgatctaatggacggctccaatcgtccccgcgccggatgaagcgccgactggggagaggggcaaaaccctagctcccaaatccctctctcctgatcccatttccctccggcgacgagcgagcggaacgacggctgtccggcaagttggtgcgcgcgtgcagtgacgaccgccgagcggctcctgcttcgctggctgggggagcgcacccgagggcggcgcaaaaccgtgccacgatgtcggcggtccggctaggtgggcgtgcaaacggcgacgagcgccaagtggcttggacctcgtcggcggtaggagcgacgccaagccgacgcttcccgtcttcggcaaaggatggtggacgggtgctctaggacagtgcgcgtgcagggaacccggcacgactgcgaggaggtgaaggtgcggtggtgccgcttcctgaaaagctccggtgagctcaggggcttcaaatccggtaagtaacccgaacccttagcttaattgatttggatttgactcctatggttcttacccaaaattagagttcttcgaatttagagaattttatcgggaaatttcaatctattttattctctcttttcgagttagggaagtttcaatatcgtttatcctcttttaattttggaaacttcaatctagtttatccctttgctcaatttcattttttttttttgctttggctggcgtttcattgtgcgggcagggacggagggcgccgctcgtcccctcggaaagattaagattaagataagataggattttcacggacgacggaagtaaattgaatcgaactttcttttatttgttttaatgtttttttcgccctttttttgttattacgaacaacggaaacgtttttaattttttaagtagtagagatagagaagatagatatatatagtaccgtgtcaaatataataggattcgacttttttttaccgcgtcacatgtaattctttttttttttggatcggacagatttgttttttatttttttcgctctttttttaccgcgtccacgcggataagtttttttgccggtctttttttcacctggttttttttatgcctgtttttttaggaatcggacatattccttttttatttcttttcgcccttttttttaccgcggaatcggattcgtttttcttttcccttttttccctttttttatcggacagatttggtttttctttttttttcgcctggtttttttcgctcgttttgttttggatcggacaggtttttttcacctggtttttttaacggacgatggaagcacctcttattgtagtatagatagagaagagatagggattttttcaaataagacggacggtccacgttagacacgaaatttttaagtagtagagatagagaagagatagagattttttcaaataagacggacggtcaaacgttggacacggaaaactagagtttgtctttttttattattattttggatggagggagtactctgctagtcagagtacagatgtgggtatgtagcgttcaccaaaactataacgttgcgacttatgcctgatgatgcgaagctcgtcgtcgtggccgcgcaccacctcgacgccggtgagcacggcgaaattcctttcatccgactcgaaatcgcagcagtattcggtgcaggtcccccggcgagagaccgtgtacagcttggcgacgcacagcttgctgtcgcctaggtggatgacgtgcgacgaatacacctcggtgaattcgccgaggtcgatggcgtgcgacgggcgcgccctgcgacgcgacggccctggcacggcgaattccctgcacccggggtgcgccggcggcggcggctccggctgctggacggtggaggaggacaggtcccacgcgccgaggacgccgtcgtccgcggcggagaggccgaaccagagaccgtgctcggggacgaactcggcgtggtcgctgaagggcagcgtccagtcgccggccttgctccaggtggctctcgccgtgtcgaaggagtaggtgccatgcctcatcgacgacagcaagatgtgcgagttgccgaccgccgcgtacgcgcaggtgtcgccgacgacgtgtttgtagtccgcggcgtgcacgtacggtggcggcggcatggggcgccagaggcaatcgtccaactcgggcttcttacaacggacgagcgcctcgaaagaacgctcggtgacgccgtcggggtgaggtgacaccgccatgacgtacagatccttgccgacggcgagcgacagtgtccagagcttgggcgtgaccatggtgggcaacgcgccgacgctgtgcttggcggggtcgtagatgattgtgcggccagcctggtcgacggcgattatcttgtcgtcattcctgcgcataatctccatccacgtgatgttgtccgtccccgaattgctgctgccggggggaaagaagttgatgtcggttggaggcaggcgcacgtcctccacggccgccggcgacgccgccgccgccgcccggtctgcatagaagagacttgatgggtcgattcggcgtagcctctggaaggaagagtctacagcccggaaatcaaccatgtagaggaatcgccggtttttcgtcttcttcactttcttctcttccaagatgccggagcgattattgggatttgtccccaatctgctaatggggttaacatttgctaacgaggaggttggggttgagtagatgcggtcggcgagcgcggcggcgcgacggcagctactggcacctaggcgatacatgttgtggatggatctggaggagaaagatgagctagcgggtgtggcggcggcgcaggggatttggaagagaagcgcaaggggatgtctcgccgtcgtcgacctgtggtggagaaggaacggatctatggtttttctctttttctttcttacgaatttttttcgtttttagatttttttttaatatttacagaaataatctatcgaccaaaaaaattgcagaaatagcctctgccgccctaatgatgggcggcaagctgacgtggcagacggtgggtcgaccgcgccgtctgccgccgtcggccaaaattgcgggctaattgccattttggccgcccataaagagcttgcggccgtacttttttcatctgggtcccttgccgccctctatgccgcggcggcaagggacccaaatgaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcatagaaacattatatggacttaaacaaggagaattatgtaacatgaagaaatagtagtacaatttgaatatgatacaactatttgcattgcggttacatagatgatattagattcgaactaggagggaggtagtgcaatagttgaacacaacaacgatgtagtaatgggacaaggaagcatgacagtagaaatttcaatatgccaagttgtccgataatagctaacccctacgtgaggatccctctcctctctcaaaccgcgctttagtaaccctgtattgctctggtagtttaagctgcacaacacggctaggtggagttagaatccttctggtgtctatccattctctgtattaacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagtcgcttttctctgtaagtattgctcagtactttcggatgcgaaataccagcgaccttcttataaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgctagtttggatcctcaacacctcggcgtctagccattgacgaaagccggtcggatttgtaatgaagcaagtggggaagagagtactgaatgtgactgagttttgaaagattgtgaggcctcacacgttaaggcgacttatataggcgcaaaaaatcgagtgatacccctgacatgtgaacgtggtggggtatggtgggtatgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcaccacgaccacgcctggtcctccgggcctgtgctcgcacgtggtcctgggagtaggtgaaacgatccggtggcacagcacgggtagcacgagtgtcccgcggaggagtggcctgcgcatggtcctgcgtctgcaccggcggtgcgcctcccagctgtgaggggccgatgacgtcctttgtcgaacctgaagcgaagtcgaagtcagtgatgtcgaagaggaaggtggaaggcaacaagtggtccgacgaggtcccagcatggtccagtggtggaccctgactcgacgtgccggctgcctgtgacgaagtcccggtgtactgccagaactgcgctgagtgcgaggttgacacagctgcctgagacgctgaccctgcagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcgacaagtgaaacggctcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagaactcggagaatcgagcgcatcgactccaccatccgcgtatacgtcgtcaggtgctcctctacgggtaccgaaatccccgcgcctaaacgttggatcgtcgttgaaccgtcaacgacgatcccggttgatgtcgtcgacctgcatggttaatttgttcgtaaatattcgtaaaatttgacgaagagaaagacatgaaaacataaaggaatggtgcgatgcagggtactcacaacatgagcgaagtcctggtcgcggtgcctggcatagaggtctctagtgctcgcaacgtggggctgctgctccaagggagcgaaggtgaccctagtacaggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgttgacccttgcgcgagtacctgcgaattaatgtttaatattagtgtgaaacgacagatgttacaaattattgtgaacaggcagattttaatgcaacaacggaaagcgtagtgcaagaagcaaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccatggcactgtagggctcccacacgacgtcagtcggcagaaggcggtcgaactccataacaaactcaggatacgaccgcctaacctggacgtgggcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgtgtgctggtccacctcagggcggccgatcgcaatcctctcagctgcccagatagaaagaaagagagggcacccaccaaaggtcgcgttgggatccgtcttcgtgcaagactcacaaagtgcacggtacagagccgccaacaacgtggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctcggcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtacggtgcgcgctgtactagtgcgaaacatgccgtcagatcgtcctgccagtccacagccgtggtcactggcccaacagcgtctcccgcgagcggtagccccaacaagtacgatacgtcctgtagggtatgggctacctcaccgcacgacaagtgaaaagtgtgcgtctttggcctccatcgatcgaccaaagctgctaggagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtggtgaaccgtgagtagctcactgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataatataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgctgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatggcatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgttgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaagatgttcaattgaggggaatttcttcacttcgtaagagctcccagggtttctttcctcgataacaccaagcaggcgtggcaaattgtcatacgaggcttcgcaagttccaaatctcatctctattattttgtttggccctccaggccttggcatagctaatagtatatttgtatgtctcttcaatgtgtcggattattgaccttggttcatatgtgagattatcgatgacatgcacatacatctcagatgcaacaaatgcacatgtaatgttcctgtggtatttctgaacaccaggtagaaaacatgtatgcttcgtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtcttatcatctgacgaatcaccttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcatctgaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtcttatcatctgacgaatcaccttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgactgttatgtcacttgtctgtggatcaactctcaagcccctcattaaccatccttttatagaaggtacactcctctcagccggtctctcaattcccctttctaatacaataaaatttgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgagggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcaggggctatttctgcaatttttttggtcgatagattatttctgtaaatattaaaaaaaatctaaaaccgaaaaaaattctctttcttacagccgctatagttgggccacagcccacggcccatggctcagcgaaccggatgcgggttggaactttggaagccaccgccgtcggaagggcacgggcacgagacgaatttttttcatttttcattttttattttttaatatttacagaaatattgtactggtaaaaatatttacagaagttgagagacgtgagggacggacaagttgaaaaaaaaaagaaaaatgcatttttggcagggtaaaaattacatttacccccatgcagctcttgtagagggtggtaagggatatcagtgcaaaatacgcacaccttgccgctctccacttgggcagcaggggtcatctgtgtaaactagcaaaatgtccgtgcgttgcacaagataatggctaggtttataaagtttgacctcgatgattcatcgaagcacctaaagtatgttctgcttgcgtcggcgcctctccgactcccttgcgcagtgggccggtgccaatccctcccccctcgtggcggctggcacagatcgatctcctttcctgtccttcgtttcctctctttgctccctactccctctcagccatagcgacggtggccgcggcaataatggccaaggcagccacagcgacagcggccgtggcggcgatggccaaggcggccatagcggtgacggctccgcagcagctaagacggccaaggcgcgcgggcggcgacgacgctggtgggcgatggatccggtgttgggaggcgcgtgggtgacggcgaggctagggggcggtgggggaggttcgagggtagtggcgagcatggtgggtggtggatccggcgttgggaagcatgccagcggcggtgaggcagtgggcagccgatccggctgctaagttcaaggcttctagtggccgacttccgagcataatccctctgcctcctgaagctgtcaccgccgcctgcttcctcgacatccctgccaaatcggagcccggttgcctcctcactaaagcgctgagcttccaccgtccgccgaagccgtgcactcccgcttggagctcacaactgcaagtcaaagtcacctccgcaaaatcaggttagatccgattgatttttgtagcaatcccgtggaagtatttatggggttggttttatctgttcgagtccaaatcgaatatgcattggattagagttctcctgtggatctcttttctgattctatttgggtggattagagtctgatttgaattcacaagttctccttttagttagaatttcaatttcgaattgggaatttgaaattttggaacaacctagctgtgggaattttgttttttccttgtggtgtgtgcatccgattttgttgcgctgattttgggaagtgtttccatgtatccgattctgatgatttagtgatttttctaaggtgcactgagggatgaaagcggcctttcccgcaaatcggaaatcgaatgcactcgtacggatagatgaaaaattagtgcgatgacggacgaaaacacggacaaaaacacaccaattaaaatatttttatataattattttttattttagttaaactttattttataatttaatgaggaggatttctttgtattttagccatgctcttattatattgggttaattggatccatgccactacaactttgccaaattaagaaaaaaaaatgcaactactattcgtcatatctgctgtatgccactggaaattttaatttgccaaagttgcagtggtatgatccaattaaccctataatattttagtccttatattttctcaattattatttttctcaaaatagtaattattatattttagtaaccttagataaaaataatataattgcaaatgcaactttgttggcccatttctcagcctctctacattgtctgcattattttccacttaattgttccctctctctcctcattagtttttcccctttctttcccacttccaccgacgagcgaacgagttctccagggacctcatcatctgcttgcggggagaattttcagaatataacactcaatacacactgctttcaatatttgtcactcaattcacactactttcagaatacaccactagagtgtgaattttcttcgttccgtgacactccgtcatcccaaaaccgcgcgtcgtcagttcattcctctcgccccgtttgccctcaccgccggcgagctcgtcctcccccacgccggcgagcttgtcctccccacaccagcgcctgcgctgctgggcgggaccatccacacggtcgccggtgacatcgcctgcttgccgccgtgccggatattgagatcgagccgccactgttggcttggaggagggggtcggcgacgatgggggtagcgcggggggaggagccgtggccagcgcctccaccgggccgccgacagccgcgcgcgtcggctgtagcttgcggcgccgcttcgcggtgggctcgtcgccgcgggcagccgccgcgacggcggagggcgactcgatggggatgcggaggacgccgtcgacggtggcttggaggaggtcagccgccggagctcgaccaccggagcgacggcggctcggttcgctcgtgtcatccccgagctcagccgccgtcgccagtccaacctccgccaccgcggcctcgagctggtatagagctcagtcgccggagctcgacgccgacgggcggcggtggggctgacgcgggcgacggaggggctgacgcgggcggcggcgcggctaacacgggcgcgagcggtggctgactgatgacggcgacgtcgggaggatggagaacgacggcgcgactgacggtaggggatggaatagcacggaacaaagaaaatttgcactctagtgttgtattttgaaagtagtgcgaattaggtgacaaatcctgaaagcagtgcgtattgggtgttatattctgaaaattctcgcttgcgggggttggaccctggagcctggagtcgaagagcttgccgccggtagaatccatggtgcggattcgcgccagcgtggaccggccaggtccgtggccgcgcagatcgagcttgcatgggctggctagctccctggtaggtccctgtcctcctctcctcgctctgctctctcttcctccatcccggcatggattgggcgcaggtgacgcggatcaacgcagccgctcccggccagcatcaacctcacttgaaagaagcagagcgattttccaccttggctggatcagatactatttgtcttcgattctgtgagtttatatttgattttctgtcttttcttcaactcgattttgttaaagtatatctctgtgtaatccgtgtgctttggattaggatggccggtggattaagctatagattagcttaggttgttgtgatcacatgtaataaggatccggccgttctatccatagcgcatgcctatttgtatcttctccatcgccgttttgtgcgataggttaacacgcatcgtcgacccgagtgcaaaggacgacgttcccatccatcctgttttcccacatggtatcagagcgctgaagttagatcccatctaccatggctagctcctcctcttccacctccacaaattccttgttctgcttcaatgtttctgagaagttgagcaagcaaaattatcagctgtggtgcgcacaagtgctgactgcgattcgtggggcacgcctcaaggggcatctgaaaggcaagaccgtcactcccgccgcccacatcgaagcagaaaagaaagaagatgacaagacgaagatcaagatcatgatcgacaacccagcgtacgaaagagtggtttgccgcggatcaacaggttctcggcttcctcttttcatcgctgtcacggaatatattatcccaggttgccacggcgaccacagcgacagatgcctggaagatgatccaggagatgttcaactccagggcgactcgcgcgcgctccctcaacgtgctgctatctctcaccagcactaggaagggaacccagaccatctcagagtacttcgccaagatgaaggccttagcagatgaactagcgatgtcagggaagcaagtcgatgccgaagaactcactgcttttatcttaaatggtttagatgatgattatgattctgttgtatcggctttagcggccaaaactaaacctattactctatcagaaacatatgcccagctattgaactttgagaacaggcttaatctacgacgagaaggcaacatgacggccaatgtagccgggcgcggccgtggcaacgctccgagcaaccggggtggtgccggccgtggacgtggtggtcgcggcggcttcaatggtgctggcacaaacgccggctgtggaggacgtggcgctggacagcagcagcgctccggcaacgacacacgacccgtgtgtctggtgtgctacaagcggggacatgttgcagcagattgctggcataggtatgatgattcttatgtgccagatgagcgacaccttgctgcagcagcctcctacgcctattttttttagataagtcaccggaggggagaggttccccacctgaattgcattaaataaatagagtaagggttacaactgagtttacatgacatgaagagattgcaagggggaggagaagatccctttccaaattgaaactacaactctatcaggaggcttaagacgttcagaccagagagaacattcgtccacacatttcctaattgctgccggaactgaagcatccaggttgcggaaaacaacgtcgtgtctgtggttccatagtgcccataagcagagaagatagaagacatggtggtgcagctcgggcaggtttccattggggcgcagacgtccgagttgacgaacatcctgaataagcgggtcaatgccgatcgtcgtccagaattgctgggcaaaggggcaaaggaagcagatgtgacttgcaatttcagatgcagctccacaaatggagtcgactccaatcggtacatggtctcaggcgccacggaccacatcaccggtgaactggacaagctcacggttagcgacaagtacaaggcgaacgatcaagtgcacactgccaatggagcaggtatgaaaatcgagcacattggtcgctctatattgcaaacccctatgcgcaatcttatcctcaaaaatgttttacatgttccacatgccaccaaaaatttagtttatgcatcaaaacttgcctccgataatgctatatttgttgaacttcatggaaaacattttttggtcaaggatcaggctacgagggcaacaatgcttgagggacggcgatacaagggactctacccgcttcctccttcatctcctgcatcctctccaaaggctgtttacggtgtggcgccatcttttgcaagatggcatagtcggctaggtcatccttcaagtcctatagcgtctaaagttattagcacaaataatctaccttgtcatgacaaggctagtaaagagtctgtgtgtgatgtgtgtcagatggccaagagtcatcaacttccttacaatagatctactagtgtttctcaatttcctttggaactcatttcctcagatgtctacggacctgctcctatttctgttggtagacataaatattatgtgagttttgtggatgattatagtaagtttacctgggtttaccttcttaaagcaaaatcagattttttcaggtcttccatgaattccaagctcttgttcagagaatgtttggccggaaaattatcactatgcaaaccgattggggtggagaatgtgagaaactccattctttctttcggcaaataggcatctctcatcatgtatcctgtctgcatactcaccagcagaacagggcagtagaacgtaaacaccgtcatatagtagaagtaggtctatctcttctagctcatgcatctatgccactaaaatattgggatgaatccgttttagcagccgcatatattattaaccgagttcctagcaaggttatttcctttgaaacaccccttgaacgcctgttccatcaaaaacctgattattctgctcttagaatctttgggtgtgcctgctggctgcatttgcgcccctacaacaatcacaaactccaattgcggtccaagcaatgtgtgttccttggttacagccagcttcataaatggtttaagtgccttgatgttgctttctgggagagtttatgtttcgcaggacgtgatctttgttgaaatggtcttcccattttctcaattaaaatcaaatgcaggcgcccgcctaagagcagaaatagctttgcttccatctgaccttgtagcgcatgatcaagggggcgagcaacagagtgatcatgttcttgattttcctaatactgctaatgaattttctggtagcaattcagatgattcgggtacagatgaaggtgtggacctagcatcaccaacaccggcgtttgaagcgcatggcgcaggagaaatcgcttctggatcggagcctaacgcgacacggcagacagcacagacactggcccagcagacgcacggcgcggctgctccactccactcaggcggcgacacgtcgctgtttactttaccaagtccggcgccgcaccagaccacttctgtgccgagccatgatgagaccggtacgagagctgacactaagcatgtgtttggttgggaggatatcccgggatgggatgggatcgtcccatttttaggtctgtttagttgaaggacaaggagggataggatggttccaaaagggaatattccttcaatattcgggacaaccccatctgggataaactggcggacaaaacgatcccaccccatgcccgtgactcgcgactcacgcgcggtaagaccgaaagtttcgcttcacctcttttttccccttcgttcttatctcttcccgttcttatcgcttccttcctagggttagcaacacacgggtggcggcggcgcgagcgtgggctggggccagccggtgcgcatgcaggggcgaggcggcgcggcacgcccggggtctctcgtcagcgcgtaggggcaaggcggcgacggcgcgcgcgggggcgaggcggcagcggcgctagcgggagctcgaggcggtgcgcgagcaaagggtcggcgagcaggggcaaggcggcagcggcacacgcagaggcgaggcggcggcggcgctagcaggagttcgagctggcgacgctcgagccggcgcgcgagcagtggcgcggcggctctcgaggaagggcgacgcggcgcacgagtagggccgttcgtagcctccaactgcacatcggggttcccattcaccacggtaaaaagaccctaaaccttggatgaggatttcgttttcagatatgtgcatatatgtttttgttcaagaatgtgtgaaatcaattgctgctgttcaagatctgtgcatatatcaatcgctgttgtaaatttcttgacagtagatgatggccatgtgtttttttggttgttgtattgtagatggacaagaggaccaaggttttagtttgtattgctgctacaaatttattgttgtcgatgatggccatgattattaggtctagaaaaagaaagagatgttcaaggagataaggtattagatatggcccattggttgaaagggataggaaaagaattgactacctagaaacaaaaatttggtggaacgatacaacttgtatcaacatgtttagacttagaagggcaagtttctttcgtttctgtaagctttttagggatcgtggtttacttgaagatgccatccacatgtgtattgaggaacaagtggctatgtttttgcatacagtgggacataaccttagaaatagattagttcgcactagttttcataggtctggagaaacagttagccgttatttcaacaaagtccttcatgcaatcggtgaggtacgagatgaactaatcaggcccccctcattggacactccaactaaaatagcaggaaaccctagaagagatccttactttaaggtctgagattcatccctatctaaatttatctttatgtgaacattgatatatggtccctaatttttaatgttgttgaacacaaaataggattgtattggagctatttgatggcacacatattagagtctcggttcgtaagaacgtggagtcttcttttcgtggtaggaagtcccatgccactcaaaatgtaatggcagccgtagattttgatcttcggtttacttatgtcttggctggttgggaggggacagcacatcatgctgtagttttaagagatgctttggaacgtgaaaatggcctccgtgtcccacaaggtaatagattactatagtttatcaaattatccatgacaaatgttgatatttaggaatgtgaccaacttgtccatcatataataggcaaatactatctagttgatgctggatatggagccaaacaaggattcttgcctccttttcgtgctgtccggtaccacctgaatgaatgggggaataatccggtacaaaatgagaaggagttgttcaaccttagacactcatccctctgtgtgatggttgaacgtgcatttgggtcactaaagaggaggttcaaagtgcttcaaagtgcttgatgatgccactccattcttcccatttcgaactcaagtagatattgttgtagcttgttgtattattcataactgggtcgtaaatgacggaattgatgagcttatagcttcgtctgattggtcaagtgaggacattgatgaatcaaccggccaagcgaatgaccatgcattgatggttcaattcaggcagggcttagctaatcagatgtgggctgaccgtaatagccatcatggaatgtaatatgtagctgggctacttgtatttctaccttatttactatatttcattagtattcaatgaacatttttatgtatttcatttgtatggacagcttgttgtactccatttgctaaatttcatttgtacggataaatttattgttgtatgctgaatttatggtttgatgaatgctgaatttatgggttgatgtattgctgaatggtgaatttctgggttgatgtattgctatatactgaatttctgggttcaaagtatttgctaaatggtgaatttatgggttaacatattgctgaatgtttaatttctgggttaatatgctgcttaatggacaatttctgtttactatattgctgaatgatcaatttctggttcatttgacagaaggtaggacatggacaacactagtggcaaaggaggaagcacccatgcttcatggacctcagctatgtcatctttcatgctgaaactccttgctaatcttgtggccggtggcacaaggacctcatctgacttcaaggcagtgcatctcaacacatgtgctagggctatgaatgaaaggttcaacagtactctcacgggtgagcaaattaagaatcatttgaagacatggcaaagaaagtttacaaagataaataggcttaggaaagtgagtgctgctggttgggatgagaaaattttcatcattactcttgatgatgagcactacaatggctatattgaggtaaatgtcttgactcttgacctagtggtttattccattcatatttttattgcaattacttaaacaaaaattttgtttcactgaatgatcacaaggctgatgctgattattttaacaaacctcttgcgtactatggtgagatgcttacaatatttcgtagcaccatggctacaggaaagtatgcaaaagactcaagttcagtcctaggaacagaagatgtccaaactgaaaatgatgaagaggaaaatgatggccctgccactactgatgatcgtgcggaggcatcatctgcaagcaagccaaagaaagctagaacacaagaaattgaagatgatgggctgattggtgcattcaccagtgttggtgacaagttagcttctgctaactaaaggtcgctgagccagacaataaactgccagatggtttatttgaaaccttgaaaagccttcctgggtttgaggagatccatgtatctgtttactatgctcatttggttgccaaccctcacattgctagagcttttgacggacttcctttcgaaaagaagatgcattgggtccacttgttcattaatgagaagtttcctagatcaatgtagagttgttggatgagttgggtagttcttttggtattatgtgttgccggtggggccatggtcatgtatgacttgtactgccaatatgtttaaggcagtgaactctctagtaggtgtaagacttaaatttgctattatgtgtaagaccttaatttgctattatgtgcacgacttggaacttcttattatgtttggcttggactctatgtatgggttgaaatgggatcagatgtgagctaattatgtgtgattgttttttgaggggttgattatggaactactagtattgttcatcatttggtagcttgtccaatatgctgaaatcctaaagcttccactgttcttggctgtagtaatgaagctgctggagcttattttcaattatagtgatatgaaaggtattttatttttgtgatatatagtgtggtcatcatgtagaaatattatttcgtagtttgtagactatgagaggtaacttcaccaactaatgtgtggaggtaattgtatccaagaaaacaaaagataggatcattccaacccatcatatccctcaaaccaaataaaaaacaggatccgttccatcccttcaaccaaacaaaaaaacataaccatcccattccaaaaagggtaaaaaaacagggatggaaccaacccatcctatcccatccccaaaccaaacacagcctaatgatgcagccatgcaggacactgagctgagttccgttgtccaatccagtgctgcaggcctagaacaagattacaaggaggcatcaggaaacccaaggtatatatagatggtactgtgcgatactcctgctttacttctgcaggtgagccgagcaatttggaggaagcactaggaaacaaacagtggaaagatgcaatggatgcagagtactcagcattaatgaagaatagaacctggcaccttgttccttatcaagaaggtaaatatcattgattgtaaatgggtatataaggttaaaagaaaggctgatggaagcctagacaggtataaaactagactagtagcaaaaggttttaaacaacggtatggcatagattatgaagatacttttagtcctgttgttaaagctgctactatcaaaactgtcatgtctatagctgtgtccaggggttggagtctacaacaactggatgttcagaatgccttcttgtatggagtgatagaggaggaggtgtacatgagacaacccccagggtatgaaaattcttctaaaccaaactttatttgcaagttggataaagccttgtatggtttaaaacaagcaccaagggcttggtatgcaaggttaagtggaaaattgcaacagttaggctttaagccatctaaagcagatacatctttattctacttcaacaaaggcagtataaccatgtttatcttgatatatgtggatgatattatagttgctagttctactaaggatgcagtgtcagctcttctttgtgatctgaatgaagatttcgcgctgaaagatcttggagagcttcattatttccttggcattgaggttaacaaggtaaacaatggtctaatattgtcacagggcaagtatatatctgatttgttgaagagaacaaatatggttgattgcaaaccggtaaatacacctctgtcaactacagaaaaattgtctttgcatgaaggtgatcaattaggacctaatgatgctactcagtatagaagtatagcaggagctttgcagtatttgactttgactagaccagatatatcctttgctgttaataaggtttgtcaatttcttcagacacctaaaattgttcactgggcagcagtcaaaagaattttgagatatttgaaatacacagcaagtctgggtataaattttgatagatcagtatctacacttgttagtgcctttacagatgcaaattgggctaggtgtcttgatgaccggcggtccactggagggtttgctgtttatcttggctccaatcttgtgtcatggagtgcaaggaaacaagctacagtctccaggtccagtacagaagcagaatataaggctttagcaaatgctacaactgaggtaatgtggattcagacattgttggatgaactcgatgtccatgcaccgagatcagcaaagatttggtgtgacaatattaaagccaagcatttgtctgctaatccagtttttcatgctcgcactaagcatattgaagtggactaccactttgtcagagaacgggttctgaacaagttacttgaggttgaatatatttcttctggagatcaggtagctgatggatttaccaagcctcttggagtgaaacagttagagatgtttagaaacaatctaaacttgagaagttcagattgagggggagtgttagagtatatccctgtgtaatccgtgtgctttggattaggatggccagtagattaagctatagattagctgaggttgttgtgatcacatgtaattaggatccggccgttctatccatagcgcatgcctatatgtatcttctccatcgccgttttgtgcgataggttaacacacatcgtcgacccgagtgcaaagggcgacgttcccatccatcctattttcccacagatttctcttcattttattcttggatccaatttttgttgccataaacttgtttttttgcccaatttatttacaagataggtttagtttgaggaacttttgggttggatctaatgtgttcatgtttccgattcggttggcttctcgagttgaggcggagggcaacgggaaacggaggcttgcaatcgcaatggacaaaagcggattatgacgaacgaaggcataatgtgacgaaaggaaaaatactaatcttttaattaagttaagattaagatatgctaggattctcccctactctcgccccttcttaccgcagagaagccacgtatccgtatcggatacgcgaacggaacgtatcggatatggcccgatacgtatcccgtacgtacctggccgcaatgaagcagagcgtgcaagctacagggtcgtcgctaatgggtgcagcagctagcgctcagcacctccgccgccaggaccagggggtccaggaccaccgccgcccccacatagtgcctccgtctccaggcacaacaattttctttcgttccatgtgtcacatcaagtgctaccatggattttggaactggaacctcaagtgctagtgcggctgctattgacgcttacaaatttatcatgagactaaggacatatttggtagagctccaacttctaaatttagctttagaagttgggtctggagtagagttgtagagctgcctaaacccagctccacatctctagtttattttgtgaaagagctccacccagctctcatcctattttagatggagctgaaactgtttagctgagctctagctaagagagatggagctagaactgaagctatgccaaacataccataatagaacatcaagggcaatcaacatctttgatctggtggtgcttggtggcttgatgctagcatcatgccacatgttagtcgacgttcaattgatattgtaaacatgatgcatcaatttattgatgattcgtatgtgttgatttttctctgatttattggcagctggcaagttaaatcagttcgccaacttgaattatctagagaggagaattggagaagattgataaggaatcggatgcaaagaatgctatgctatggattactccctccgtacttgtaaagaaagtcatttaggatagcgacacggtctccaaacacaactttgacttcttgtttctataaaaatatttattgaaaagtgatatatgtatatttttatgaaagtatttttcaagacaaatctattcatataatttttatattttcaaactcaacaacttgagagttattcatgatttatatacccaaggtttgacttaaacattgtcctaaacgacttcctttacgagtacggagggagtatttccttacaacacttcactatttatatatttttaatctctactattataaaaattggagatgtttttgccggtactttggtacgtcatccgtgcatgagtcggtttttaagttcgttcgcttttagaaatatagatccgtatttaagtcaggttttaaattcgttcgcttttggaatacagaagtagtcgtataagaaatctctttaaaataaactcgcatgttaacttgacatgattttctagaaaaaatatatatccaagcgagttatcacaatgaatttcaatagcctttaccgattgcaacgtacgggtatttttttctagtattatatataagtgtatccctgtgttgacgcttttttgtggccaacacaacattacctaacaatttgcagtgtaaacaatagagtcgccaaaatcaatagatcaaaatcggctagtggaaccgatttcaagattaattcactttcgcggaatcacacgactaatttataaggaaattagcaaagagggtaaatatcagcaaactagcaaaggataatctcctcgctttcgtggtgaagcacgaccgtttttcagcgcaaaacggcaaatattaactaaattctagggttaccagaactcagctatgaaaacaaaatagaaaataataggaaagtaaataacaagaaaatagtagattgatatttttttttgggggggttcctcaaaactaacctaatacactaatatttataggagcacctgaaccctagccgcaccacttgagcgtacatggaaactccaataaattagctaacagaatccgactccatctaaatattaacaaacaaaaaataaatagttcgcatgcaatctaatgccagtcttccagcctgatcactgtcacccttcggtctatgtggcacgggtcccgtgcggcaacagcagcacagctcggcaaattaatcatcaatcaagcactgatccccgtcgcaaatctctcctaggctgcatgcatgtgacaagtccaaaccaaataaattgctgctgcacccagcattatacacagatcatccaagcagggcatcacaaattcctgcacacatatatgtttcaaaactctcgagcaaacgtctagataaatgtaccaactactctcaataatttggcctgcccaaataaactaattttaagccaaattatggtacaaacacatacccctgttttcagtataagaatcataacttttttttaccgaaaacactataaaaattaaccactaatatgatatttgtcctaaaccaatccacagtcatcttcttagaacgatactttgaacacggtatcagttctgagcccatccatagtcgtcctctcaaaatgatactcaaataggtatccgttttaagcctatccacagtcgttctctcaaaacaatactcaaataagcattcgtcttgagacaatcaaacctcctacaaataccttctcaaatattttccatttagtacaaattttactactaattcggtcatcactaatgtccacctaaccgaattaacctatcctccaattctggctatgatactacactatctgtagctattaaccaccaggtactagctcagccacaacgacaagacgtacaagcccctgtctccattgtattcagctagccgaaccatcatactccaatgaggcatgtacactactaccagaacgtacacgtacgcatacacctcattagcaccgaaaccacatgcatgtactgtgtacccctatcagaattcagaactacccggcaccagcactactgcatgtattcaccaaagtgttactactagataaatcggcttgcactaaattgccatgcaaactaacactacaatttgagccgattcattcagtagcagttaacaagaagacttgcgtcaagtaatttgctttgctatcttccttcctcaatatatgacgaacagtaaaggtatcaagcggtttgattaaaactaaacatcgatccatataacaatttagcaatcactggtggagaaacgatttttagttccggttgggaactcctctatagtcccagtttttcaaccgggagtaacaatccgggactaaagatatctttagtcccgggtatatctttagtcccggttcaaatacccgggactaaagatcgatcgggactaaagatgtggtcccggttggagggttttttcttttttttttttcttttctctcttcctttttcactgttcttttgctatttgaccaaatcatctcagatcaaacattcacagcattatctcagatcaaacattcacagcacacagcaatatagttcatccaaatcattcacagcaatagttcatcccaaatcatccacacaatagtttatccccaaatcattcacaacaacaacacagatcaaatcacacattcaactcaatcaacacacagatcgaatcgcacattaaggaaaaaaagaaaaaaaatccaagctccagcttccaccgcctgccgctgcaccagccgccgccaggcgcggccctctgcgcgtgaccgccgcccagccgcctcccctccggatccgccgccgcccggctgccgcggtgtcacaccctgaaaattcaaaatatataaattgttgtttaaatggaatttttagaatttattgtaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccttctctctctcctcggcccagccgacccagtccgcagccgccggcgcccgcgcgtccgcccgctgacaggtggggcccgcctgtcaggtcgtcgtcttcctccggccgaaacccaagcgccgcgccgccgccgccgctttccaattcggccgatcctttccttctccggccgaatcaatagaggagaaatgatcctcgagatctcctctaccttttctcctttggaaacaccggctaaaatcgtttggaaattcgtggattcgagtttgtttcggattcgattttcccgaactttccttctcgtcgccagccgccgtgggccttcgtcgtcgtctcctagcccctttaaaaggttccccggtgtctcctctacccgccgccaccttcgccttcgcctctcgtcgtcggaaacgccctagcgccgtgtgccctagcgccgccgtcgtcgccgtcgctccagccgtgcgccgccgccgttccagacgtcgccgtcgctcgggaagaccgccgtcgtggtcgccaagtcgtcgccgtcctcgtccgccccttcgctgtcgctgtagaccgccggagcaccgtcgccgtcgtcaagccgaagagcgtcgccgcttcttcttcgtcgccgtcgccgtccgttcctcttccgccgtcgctttggtcgccggtgagttcgccgtgccgtccgctacccgttggtgccttccgttcgcgccgccgtgccgtcgttcgccggcgagcatgcaagcccgagccgccgagccgccgccgccggtggtgacgtcatcgctgacgtcatcgtggctgtccgccgtgagccggtcgtggaccgatcgatctcgaccgtccgttttggatcgagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatatccacatgtactgtttatgcttgtttatgtgctgttttggtgattttgctcttttctgcttagattccgtcgtttccggagagtccgtttttgccggagaagagtttgaagagttccaaggccagcaaggcaagtcacacagatcccaaacaaccctttgagcatgttgatcatgtttaaagctattgtttcttttcaactattgcatttattttcgaatgtcattgggtggaattaacctattcattgttatagccctttttgttcttgattactttattccttgatcccttgggttattataatttgactagttgagctttatttatatgggttcaattagacattagatataattgcttagccatgcttagaaacattagctcactattgggataacttatgactcactattatttaatgatggcttaatgatagttcacgatggacaatcgtgattagttaatgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagtcgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaaatacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtaaatctcaattttagaagaatttagagacttgaaccaactaaatcggagctaagatgaattagttatgaatttttaaagattaaatcggattaaaacacttatatcggttaaaattgaattatgacgcaataatgaattatttttgaaaaggaaaagagaattattgcgtcagcgggctagggtttggtggaccgggcgcacgggcgacggttcacgcgaacggacggccgagatcgatccatccaaaacggacggccgagatcgatcgggtccacggcggctcacggcggacgaccccgatgacgtcagcggtgacgtcaccgacagcggcggcggctcggcggagcggacggctcgggcggcgcacactcaccggcaaacggcggcgctaggacgcaaacggagggcaccaagatgtagaggacaacacggcgaactcaccggtgacctaaacggcggcggaagaccaacagacggcgacggcgacgaggaggaagcggcgggaaccttcgggtcgacgacggcgaagctgctccggtgatctccggcgacggcgaaggggcggacgaggacggcgacgacttggcgagcacgacggtggttttcccgagcgacggcgacggctgaaacgacggcggcgcacggctggagcggcggcggcgacggcgaagctagggcacacggcgctagagcgattccgacgactagaagcgaaggcaagggtggcgacgggtagaggagacaccgggggtccttttaaaggggctcggaggcggcggcgaaggcccacggcgacggcaacggcgaaggaaagctcgggaagaacaaatccgagacgaactcgaatccaactctttccaaaacgatttagccaaagattccaaaggagaaaaggtagaggagatcccaaggatcatttcccctctttcaattcggccggagaaggaaaggaacggccggatttggaaaggaaacggcggcggcgcgaaactagggtttcggcggcggcggccgaaggtagacgacgactaacaggtgggccccacctgtcagcgagcgagggcgcgcgcgcgggcggcggactgggccggcttgggccgaggagagagaagagaggttttgggccgactttcggcccaaagccaaaagaagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaacaagatcttctcttcaagacttttaaaattatttctagaaattccatttaaacaacaatttataaattttaaaaaattttcagggtgtgacagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccatagttaatgatgctataactggtaataatttgattagctcctggtttggaatggtatattcctggtttggagatagaactgtgcagccggggtggttgttcagaatggttgggcctatgcaacagggtatgttgtatagcgttgatttaatattgtttaattattacttaactgttttattaaattctcaaaagtttgttaaatgctgcttttgcaaatgaaaccctactatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatctttctttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagccccttgaccctaggttatgccaaacggttacccatagaagccctctaaaaatattggaaaagtagaactgttctcctccctttctcttttaaaccaaactaatggcacatgcacttcataatctcttttaatggttctcattaaaaatttattccagtgttattagtactgtacatctattactgtactaatggctcatttaccagcaaaagttttacaatattgctttatttaatcttgctgcaataaaataaatttagcatgttgattttataactttctttcatttcttttgaaacctgttattcaaaagtacaaaacttgtgacctcgtttccaactgtttcaacttatcttgcaagcttggtttactttgtttacttacctttttactttgattttctaactttattcaaattaatccaaaaacttttgctattaattggataaatgtcttaactccctcctttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcaaagctggaggaagaaactacatccatgcatgtcaggaagtggcaaggatcgccataggagagcttcgcgatcgctacagtgatcaattggccgacactgagtatcgctaccatcctcgtcaaccacagggaagtgaccgtggcagttaccttgagactgaaggaattgagaatgatgctaccacaaggcatttggtggagatgctgtgggctatggatgaaagtcgtgcggagattgtgttagcagctcaagatcgtgaagaccggaatcgtggtaagatttgcaagctagaagacaaagtggatcgtttggagaaggaactagctgtattgaagggagaagcaccaccgcagaaggccaggattcgtctcaccgcaaggaagagagctctatttgtccctcgctatcaattggcgccaaaggttcgtgtggtggagaaagaagttgccccaaccctagcagatcctccggtcatcatcataagtgatgatgaagaagaagaatccaagcgcaaccattccaagattgagtgggtagcaactcaagatgatgaagacgagccgaacgagcctttaatcgacctccgatgctcggaagaactagagtgacttgttaagccgttgtcttagatcgttgtgttagcttgcttgttttaagtttgcttgtgtgtctcgcatgtgatttacatcagtagtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagtttcccccggtttctcttcttgtgccctgtccatgccagatggtgaacactcgcagcaacgggaatggccccagtaacaataacaacggagagaatcccactcttgctcaagttcttgctcaacagacacagctaatgaacatgatgatgcagcaactccagaaccagcaaaaccaaggaaataaccatgcacctccccagaacaagttagcagaatttcttcgtgtgaggccgcctgttttctctagcaccactaatcctgttgaagctggtgattggctgcatgccatagagaagaagttggatttgcttcagtgcactgatcaggagaaggtctcatttgcatcacatcagttgcatggccctgcctctgaatggtgggatcacttccgtctgaacaggactactgctgaacctatcacttggcttgaattcaccgctgctttccggaagacgcatataccatcgggagtggtgtctctcaagaagaaggaattcaggtcgctcactcagggatctcgctctgttacggagtatttgcacgagttcaatcgtcttgctcgttatgctccggaagatgtgcgcaatgatgaagagcgccaggagaagttcttggaaggacttaatgatgagctttcttacccactcatgactggggattatcatgatttccagaagttagtggataaagctattcgccaggaggaaaagtacaatcgtatggagcaaaagaaacgccggattgctcaattcaagacacaacaggggaataatcagaagccgcgtcttactttaggaccccagtctatgccacagggaggttcttcgtctgttgttcgtccgcagcgtcagttcttcaacaacaatgctggcaacaacatccgtaatcaagctccacatcctgttgcagctccagcacagcaacaacctgccaagagggagcaaggcagcaagcccgtggtgtgtttcaactgtggagacccaggacattatgctaacaagtgtccgaagccccgacgcgtgaaagttgtccctgtccagagcaactctactgtaccagcatcaaaggcccgtgttaatcatgttgctgctgcagaagctcaagatgctccagatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccattcctggccaatcttatcttgttagaatccaaagaccttgatgtcatcctagggatggactggttagccagacataaaggtgtgatagactgtgctaacagaaaagtaactctcaccagcaatgatggtcgagttgtaactgttcatgcattgtcttctgagtctttaaggtcaagactgaaccagataactttggaagagatttctatagtccgggagtatcccgatgtgttcccatatgatttacctggtatgccgcccaaaagggatatagagttcagaatagatttggtacctggaacaactccgatccataagagaccttatagaatggcagccaatgagttggcagaagtcaagaggcaagtagatgatttgcttcagaaaggatacatcagaccgagttcatcaccatggggagctccggttatttttgtggaaaagaaagaccatacccagagaatgtgtgtggactatcgtgcactaaatgatgtgactatcaagaataagtatccactacccagaattgatgatttgtttgatcagcttaaaggtgctactgttttctccaagatagatcttcgatcagggtatcaccagttaagaatcaaagaggaagatatacctaagacagcttttaccactaggtatgggttgttcgaatgtactgttatgtcttttggacttaccaatgcccccgctttcttcatgaacttgatgaataaggtgtttatggaatacctagacaagtttgtggcggtctttattgatgacattcttatctactctcgaaccaaagaagagcatgaagaacatcttcgccttgcactagagaagttacgagaacatcaactgtatgctaagtttagcaagtgtgaattttggttgtctgaagtgaagttccttggtcacgtcatctcagccggaggagttgccgttgatcctagtaatgtggaatccgtaaccaactggaaacaaccgaagacagtttcagagatccgcagtttcctaggcctcgcaggatattatcggaggtttatagagaatttttccaagattgctaagcccatgacacgactgcttcagaaagatgtgaagtacaagtggtcggaagaatgtgagcagagttttcaagagttgaaaagtcgcttgatatcagctcctattttgattttacctgatccaaagaagggtttccaagtgtattgcgatgcatccaaacttgggttaggttgtcttctaatgcaagatggaaaggtggttgcctatgcatctcgtcagttacgtccgcatgagaagaactaccctactcatgatcttgagttagctgtagtagttcatgcgttgaaaatttggcgtcattatcttttcggtactcgtacagaggtatataccgatcacaagagtttaaagtatatctttactcagccggatctgaacatgagacaacggagatggttggaactaattaaggattatgacataggaattcattatcacccgggaaaggctaatgttgtagcagacgctcttagtagaaaaggctattgcaatgctacggaaggacgacagctgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaaaaatatgagaagaggaaaagctatcggtttcttggaggatgagcacggaactgtatggttgggtgagagaatctgtgtccccgacaacaaagatttaaaagatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaagtgggaagaaatcggtatggattttatcactggtttacccagaacgtcatcaggtcatgactctatttgggtgatagtcgacagacttaccaaagtagctcatttcattccggtaaagacaacctattccggaagtcgcttagcggaattgtacatggcaaggattgtgtgtttgcatggcgtccctaagaaaatagtgtctgatcgaggcagtcagtttacctcaaatttttggaagaaacttcaggaagagatgggttctaagctgaactttagtactgcttatcatccgcagacagacggacaaaccgaaagggtgaatcagattttagaagacatgttgagagcttgtgctttagatttcgatggaagttgggataagaatctaccttatgcagaattttcgtacaacaacagttatcaagctagtcttcagatggctccttacgaagcactgtatggtcggaagtgtcgcactccgcttttgtgggatcaaacgggagaacgtcaggttttcgggacggatatcctaagggaagcagaagaaaaggtaaagatcattcaagaaagattgcgagtggctcaatctcgtcataagagttatgccgacaatcgccgcagagatctaagttttgaaggagattatgtgtatcttcgtgtcacgcctcttagaggagttcatcgtttccacaccaaaggaaaattggcaccgcgttttgtgggaccttataagattgtcagtaaaagaggagaggttgcttatcagttggagttacctcaatctttggcaggagtccataatgtgttccatgtgtcgcaattgaaaaagtgtttaagggtacctaccgaagaagctaatctcgaacagatagaagtccaagaggatctgacctatgttgagaaaccaatccgtattttggaaacagatgagagaagaaccaggaatcgagttatccgcttttgcaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatatataaattgttgtttaaatggaatttttagaatttattgtaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccttctctctctcctcggcccagccggcccagtccgcagccgcccgcgcccgcgcgtccgcccgctgacaggtggggcccgcctgtcaggtcgtcgtcttcctccggccgaaaccctagcaccgcgccgccgccgccgctttccaattcggccgatcctttccttctccggccgaatcaatagaggggaaatgatcctcgagatctcctctaccttttctcttttggaaacaccggctaaaatcgtttggaaattcgtggattcgagtttgtttcggattcgattttcccgaactttccttctcgtcgccggccgccgtgggccttcgtcgtcgtctcctagcccctttaaaaggttccccggtgtctcctctacccgctgccaccttcgccttcgcctctcgtcgtcggaaacgccctagcgccgtgtgccctagcgccgccgtcgtcgccgtcgctccagccgtgcgccgccgccgttccagacgtcgtcgtcgctcgggaagaccgccgtcgtggtcgccaagtcgtcgccgtcctcgtccgccccttcgctgtcgctgtagaccgccggagcaccgtcgccgtcgtcaagccgaagagcgtcgccgcttcttcttcgtcgccgtcgccgtccgttcctcttccgccgtcgctttggtcgccggtgagtttgccgtgccgtccgctacccgttggtgccttccgttcgcgccgccgtgccgtcgttcgccggcgagcatgcaagcccgagccgccgagccgccgccgccggtggtgacatcatcgctgacgtcatcgtggctgtccgccgtgagccggtcgtggaccgatcgatctcggccgtccgttttggatcgagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatatccacatgtactgtttatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctgtttaaagctattgtttcttttcaactattgcatttattttcgaatgtcattgggtggaattaacctattcattgttatagccctttttgttcttgattactttattccttgatcccttgggttattataatttgactagttgagctttatttatatgggttcaattagacattagatataattgcttagccatgcttagaaacattagctcactattgggataacttatgactcactattatttaatgatggcttaatgatagttcacgatggacaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcatagtaaaactattcgaatagccgtgcccgcggttatgggcgggtctaacaatgtctttcgtgattagtttcacacttctcaccatagttaatgatgctataactggtaataatttgattagctcctggtttggaatggtatattcctggtttggagatagaactgtgcagccggggtggttgttcagaatggttgggcctatgcaacagggtatgttgtatagcgttgatttaatattgtttaattattacttaactgttttattaaattctcaaaagtttgttaaatgctgcttttgcaaatgaaaccctactatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatctttctttccgctgcttagatctttattgattgagaggaagtatctacctctgtaatgacattttattcgcttattaattagagtaatatttgtactctattatcaatttgttattgtgtgcctcggctgattcctggacgagggttcacacacatgtaagcgtttggaattttggatagaaatttcgggcgtgacacgcggcgcgaggccacctccgccctgccgcgcgagggccccgccgctgccgcccggctggccgccatggcgcgagaccgcctgcgcctctatccggccgccgccgccgcttggccgctgacgaaagagaagagaggggaggaatagaatggggagaggaggaggaggaagaggaagagatgggaggagcaagagataaggttagggaagagataaggaatagaatttattaactcctccatctcgcgcatgcctcgtcctctccgccacgcatgcgcgcatggtgatattttgttccagtttaggctaccaatcgggactacaaatagatccaccaaccgggactaaagataataggtatctctagtctcggttggtattatcaaccgggactaaaaattgatctttagtcccggttgagaacaccaaccggaacaaaagataaaaaagtagctataacccggtttttattgcaaccgggactattgtggtttttggctgaccgaccaaagatggtttcttcaccagtgaatcctaaactccccaactaaattggtggactactagcagcaaatcacccaaagcatctacatcctcacaccaatattaactaaatttccaaaccgaataacaaagccttgtattcggtctaaagtgtaagggtattccaaataaaccgatgtctcataagcaaatactatttggcaaaactaaaacagtaccaacatcttgccgacttgcacaaaatatgaccgaaataaattataaaaaaaataaaaaaatcacagttatttctagctcccaaatatttcggtctctaaaaattgataacaacatctacaattattagtaaatatacaaaactatatggtaacatccctccataatatagactcatatgatatccaagaatcataataagaccatgaaggataaccttacatacctgagaattgattccaagacatatgcatcggttgcataggtgaagaatatatataatatggtggcaaaagaacctgatgatctgatgcaaaccgttgatttggcacacacctcctaactaccttctcattctttgcctccactttaactttaacatctgttttattctgcacctgaacacttcctttaggaagccatgacatacctttctccctcagcttttctacacttagcttgtggagctgcttcttctgccaattcgacaagctgtgtgaatgtctcagttggctgccattgccccccgagctcttcggcggatcctgatttgttactaactctgccgaagatgtctctcacttcatactcacatgatgtacattttctagctgttgtacacgtgcatgccccccaggttcaataaccttttttctaaactaaagccttttgtacactcacacatgcaccagcagctaagctcttttcttgaactctagacttcggcacctagatttgcttccttgttgaactacctcccacctgtaccgaagacttctttctactagaccacctagaccgatttctcttatcaaatcggttatccatggcatgtgacttttctggagttgcaacatgcaatcgaccttcattaatagctgattgtattttctgacgaaaaatattacaatcactagtgcaatgatcaaatgaattatgccacttacaataaatttgttcttctaaatcttgaagcgatggcatgacatgatgatccggcaatttaatataatcattctttagcaaatcatcaaaaatatgatcacacatactccaatcaaaagtatacttcttttcctttaaccgacacttttgtggagacggttttaaagctaagcaaacaaatggttcagatttactatctacccattcggctacattgtcgcttatatttcccttgtccaatgatttagaactatctgctatatcagcaccaattttaattttgtgcttctagctctagattgatcataagcaaaccatgtagacataaactttgtcaatgatgaaatagaaaatttaaacactttattattgccaacaagaatattaatctccccaatcgatctgttagaattattcatggtgacattattaatgtatggattattttcagaagcatgatcaaattgagaaataagcaaattacctgtaaacgttaccttatctaatgtgttggagaagcattctgattttttcacttgaatgatgtctaagttcgttcattgatggctctccaatatttccgccttgtcgtcgcgatttcgtgatccatcgtctagatgttcatccacttccttggcacgaaattcagctggcaaaacaaaaggtcctatgtttccagataaatcaagcatagctacctccttttcattagccgataattctaaatttatcggcttttgctgtttcgcaataacactattctttgttttctgcaagcgtatgagtttatgttcccttagctctgcaatttctacctcgacttcctgctctaactcacaccgttggccctcagataaatcgtctagtgtgacagtgttattgtcgagatcgaaattgtgctcttgatcaatgttggcaatttttgacataggtatttcagtttgcccccaaccgaatttacacaatttgaactctgcgtgtttgaccatatacatagtactatttgattgacattttgaagatggcaaactatgtgggggtacaaaatcactagtggaactactattaattcggctataatcgctactagcatatgaagccgaattatttccactagatactatataaggtgacccataagactgagatgtgactgaccgatacttggcatgccatgcaatgaattaaaagaatcaactggataattaatattgtcatggccatacatatctttcatcggcaaaatttgttgtgtaacagtaggttgtgaaataatcgccgatgaattaaaaggtgtgtgtatatattgtatattactagcattactgaattttaaagtatgtgaattactttgcataggcagtgacatattattttcgtaattcaaagatctcgaataattatttgaataatcactagcaaatgcaatatgtccattaaaaataggtctagcaatatttgtatgagaatatgtggcacttgtaaaattgtttaaagaaattggtgtagattgtacctcacaattaacatagtaaggttgcggcgtagtagtccagtatgtctccatgaattttgtagcagggcttgttcttttcctggtgcaattcgtgtacctagcaaaaatcagagaaattaatttgcacttacagaccgtgaattggttgatcgctagccaactgatctccttgttgaccagtgtatgtagttcactgttcccaatgcaaaagtttctatacaaaagttgcttaaaaaaatcatattaatcatattgatctatttttgaaaaaaaattaaccaatacttaattagtcgcgcgctaatggactattccgttttccgtgcactaatggctggttgggaacatcccctacgaacacagcctaagtacatgaattattttcatcagcctgatttgaaaaaaaaaaaaactacttagaataccatattaaagactactgatgtgagaatctgcacaaccattgtctaattgaacttctgactgaacttttgttcaattagacaattaggcaaggatcatctgactgaacttgacacagcaagtcggcaggtggaggtatcctgatagataaacagatcacataaacaactcaaacatcgcaaacctgccaatctcataataagagaacattaatttgcagctttacttacttcgatttcattttttctcaggtcaagaacaaaatttacatcaatgcgcggttgcaatctgagtagtgatcttttactccgtacagtgatgacgcaaaacttacaggagatgagctactacaactaattacacttcgcatgtccatggaaataaggtttgcatatactaactctgattctctaaaacaagtctccgtatttcaggctccttgcagcatatggctttactctcagcttgctattcttgcccaactgcttgtggagttgtggggtgaaacaggtatcaccacctgcagaagaagttctagttctgaaagacaacataccttccatgatacattgatgccttgttgcctccagataggctcagaagtctatcatacctgttcaacatttgggggagatcacgaaaatgtattcagcagtgaaccctagatggtagtgaaggttatatacatatacatgggccaaatgggctaagtgggccaactgaaccaaaacagaaatatatatatggtgtatacattaacaccccctgtcaaactctaggtggatcaacagccttgagtttggaaagaagaaaatcatgctggtctcgtgtttgcggtttggtgaagaagtcagcaacttgaagttcagagggcaagtaatgaagacagattgtcctgtgttgataatgaaatcgggtaaaagaagcatcagtccctatgtgtttgctgagttcatgtttgacaggatttgaggctatttggatagcacttgtgttatcacaaaacaatgaagttggttgtgagaggacaacaccaagatctgcaagtagccaacggagccatataacttcagctgttgtagttgcaagagctcgtaattcagcctcagcgcttgaacgagagatagctgtctgtttctttgacttccaagcaagaagagaagatcccaggaagatacaatagccagtaatagagcatcgatcaatagggtcacttgcccaagtggaatctgaataagcttgaagctctaatgagctatcacgggagaaaaatataccacgagatggcgtcccacgtagatagcggagcactcgtaataggtgagcataatggacagatgtaggggcactagtaaattgactcagaacatgaacagcatgtgagatatccggtcgagtaacagcaagatatacaagacttccaacaatatgtcggtatcgagaaggatctgaaagtggattcccatcagtaggacgaatcttgagatgaagctccataggagtggcagcagttttatcatcacttagaccagagcgagatagtaagtcgagagtatatcgatgctgagacaaatgaaaaccattcggtgttgaagcaacctcaatgcccagaaaatactttagtggtccaagatcagtcatcatgaattgctcacttagacgttgcttcacgaaggcaacatgagaagcgtcatcacccgttatgatcatatcatcaacatagagcaagagaatcgtacgacctcgagaagaagtgtggataaatagggcagaatcatgctcactagcaacaaatccagcttttagaacaactgagctaaagcgctcaaaccaagctcgtggagcttgcttaagaccatataaagcacggcgtaggcgcaacacatgaccagatggacatgtcaaacctggtggaggctgcatgtagacttcctcttgcaaatcaccatgaagaaatgcattcttcacatccatctgtgagatctcccattgacgagttgcagctacagctataagggtacggacagtagtcatgtgagcaactggggcaaaagtctcatcataatctcgaccatattcctgctgaaaaccacgagcaaccaagcgggccttataccgttcaatagatccattagagcgagttttcaccttaaacacccacttgcaagtaattggaacagcatgatggggaagaggaacaacatcccatgtacccgtgcgctctaaggcagaaagttcctcattcatagccaatttccattcattaattgtaacagcctcttgatatgtgcgaggctcctgaacaccatcagctattgcacaactgtaacgaggatgtggcataattttactgcgatctcgaagaccatatcgtgctgcaggagatggtgatgatggtataggcatatcatcaacaggtagctcattagaatcatcaagtgggtgagagacaagggaaacctattgcttcctagcagattcggtaggcagcagcaaagaagattgaggacaggggaaacttgccggcggaggagaagagattattagcagcagagcagatcgctgatgcgacgtccaggacgcagctccggcgaatcccaggcaagctctgataccatgttcaacatttgggggagatcacgaaaatgtattcagcagtgaaccctagatggtagtgaaggttatatacatatacatgggccaaatgggctaagtgggccaactgaaccaaaacagaaatatatatatggtgtatacattaacaataccaaagatgctctctaccgaaggattcactaaacaacctttcatattttcatctttatttcctaaacctaaactcaactttttagtaatggacacaatttctcggtccaggaaaacagagaatgcgaccaataagaggatttaagaaaaaaatcaaagggctatacctatactgtactgcactagtcactagatattagtaatggtaagaatagggcctcaaggtagtttgatatacaaatggttgctcctatagacataggaggctatagaagacaaggggtatgaaagcattgtcgagttgggctgtataagcttccaataaaccgctcaacgtcacagctaccaaaagtgatatccaatgctgtgttaatataaaaagagatggtcaggatttatgcttgctttatattgtagaataaaagcttcaaacggttcaatgccaggggggaaagtaaaacctgtgaaagtatgtagccacttgaagctaggagtgacagcaggattgagcaggctgctaatgcagaagttatgcctgctgctgtgccctcaattgttttctctaacatttcaaaagtatgtgcataagagatcaattatcaatcatggaataaataataatggaaattaaactcacttcctgtcttgctccatcttaggacaccatacttataacatatcattgatgcctaggtaaaacaagagaattcatcatactgaatgcagctaacataagaaaatattaactgatcacacactggacatagaacttaccatggtatcaccaatacccaagctgagaattccagcaaatggtgtaagaggtcggtcattgaatcctgatgacatccatttaggaagtgcacatcccagcaagagtgagaaatgactgaacaaaacaaatatagtattaggtctatccaagcactaaacatgtaaatgagttaaaatctggaaaacaacgaccattaatccagacctacctaacaattagaatctccgaatcgcggtgatcagtgaaggcactcatgaactgatgcacaatatgcccaagagggtatatttcccaaacctgaggtcagggtgaaacatttcgtcggagaaattagcacatgttggcatacaaactgccaaaaaacagagaaaggggagaaagaaacaggacacaaataaagaaaatgcttactcgaaccatctccaatattaagaaaacggcaaatgtgtggcatgatgtgtggcatggcgcatgccctttgaaaatttgcttcccaagaatttttgagatttgcaatcaacaaaacatcttagttgctgaggtctctgcaaatgctaatgctctcactttcagaaggtcttttggggagagagagtctgaggaatggctagctattggggatatcattaactctattgagttgtctgatgacccagatgtgttcctttgggggcttgataagaataaaacttacacctctaaatccatgtatagagcaattctctttaggggagtgactgacactagaatgcagggtgtgtggaattgtccctgtcctgaaaaaattaaacactttctatggcttgctttgaaaaacaggatacaatctgctgaacagctgaagaaaaaaggatggaagggctctgagttttgtgtactttgtgggatgcttgaaaccactgatcacattcttttccagtgtccaatggcctctttagtctggtgcttatgcagagatgcttttggcttggagtattatacctaggtcttttgaggatttcttcctgatcaatggctctttgggtggggctgatctgagagttttcttgaccctacttgctgcagtttgctgggtgttgtggtccactagaaacaacatgatttttagagaaaaattagtctactcacccctatcattaatgttccaaatcaattcatttttgcagctctggagaatccttagcagcaaggacactgagaaaattgacaagattttttttttttttgccgggtcggccgaaggaactggcgaccaaatttcattaagattgggaggaataaaatcaaagtacaagtagttttcgcttgcaacgacaggaggctgtcgaattagactgtggcaggaaccacagcccggcaaactaaaaaactggaacgccaacacaacagaaagaaaactaagaactgcaattctcgaaatagcctgcttctttccacactaagatctcttctttgatagcctctgctaactggttagggcttctcgatctttggtcgaaaattgacaagattactgggaagctcatggatgctacttcaactttgagacaaccaagatctggagttggctgatcgtctgaagtttttagttcttagtcgtttgcttagcttgagagtttgttaagcctgtcttagagttgttttgtttccttttagtgctggtcagcttttatcccccctaatggtgttaattctggacctttcctgtgtgtgatgtaaaatgggtatcccccataacgatgccgtgtttggctttctataaaaagccgggcctaatggcctcagtttcaaaagaaaacggcaaatgctgcaccaaatgctaagcccaagaaatcaggcgcaaagagaaacaatttattgagagtgtgtttcaaacaatctgatggggatcgaataaggaaaacatacaatacctgaaatattattgcaggagagaaaattaggacagcaacgggatggtaatacttgcgcaaaagaatcctctccgttttgctttgttttgatatactgtagaaccttctaattgatacatatatcacaaatatccagtatgcgcataaagcaagccgttcacgtgaatcggtgaaaatatagttaaaaaccctgtcaaacaataaaccattaagtgaaccaaaattcaatatgtacaaaaatgcacaaggtttagaagcaacaacagaaagaaatttttcaatatttgactaacagatttcgtgcttttatgcccttccaatgaaatgcaaacttatatgctcaccaaacaaatggatgcacttcaaaatcttgaataagacgcgtccatgatggcactaacaacaatagtgctaccaacaatgaaacataaaatacatcacagtcaattctcttctgtgtgcattcctcaactgtttgtgttctttgcctccccagttttctacagtaagccaaaacttgaacggaacttttgtataacaaggggagaagaaaaggaccaagcaaaaccccctgcagaaaagaaaaaaaagggaagggtattatgcactaagaaactgaagccatacaacgcaataacttctacctgaataactgtgcctatctagcttcgagttccaggtgcgcgaataaatgcttctgatgatacggagaacttcatctgccagcagcacggttgcaaacgtgaaggcaacaaaataagtatcagatttgctaccattttgctggtaaaacatatatagttcaaggaataaatcacacctttgaaagagtatgagccagcatatcaccacagtaaagaaaaagaccacttgagaccaaaatggcctcccctaagttcacacaaaatgtaaagataagttaaaaaaaaaaagcaattgcttcaagtcatgatgaaaaggagacatatacattgcatcggccaataggaacctcacaaattagctgaatttaaattttaaaaaatgaacagtgtagatataatgcactatgcctgcatggaaactggtaggataactagaaatcgtatggatagctctaaagtataaacatatgcagtcagatatacacaaaaaaactttatctaattacatcttagacttcaggtacaaaccaaaagatgaacatgaagggaacttctctagaatatgctggattaagatcacagcagccactccacgacagagcaaatacaccaaattactcatcaccagcagatctattaagacaaaacctagattagtttgtaattccttgcttctgatgaacttccaccagattttgaaaagaaagggtgagattatatctttgcatgcagataaaatatgcgtgtacctccatcagtcttcagtaaaaagtggaacaagtatgccaggggatataaaatgatgagcaacgagccgtatttcgaagctatagaatttccattgctgggagactgccgtacatgccaaacaaaaaatgctaacacgctgaggcagctaacagatactgcccagtactgcatttcaaggtatgcatattctgacaatgaacacatatagttagtaaacctgatgtgttaccgaaaatcttagtgtcaaacaagatttgaaatgttgatgaagacttaggaaaatatccatttagtagtggatctgataaatttgataaaatagaaaaaatggataccttctcgtccattaggatctgctagtaagaccctataaagttgaattaaccgtgaaagcatgacactaggcagagtagtggcgccaagaagtatgcctgatgaagcacctggcctggatcaagagcatcaagagcatcaagccaccacaagaaggtgaagttttatgctattcctcacaacacaagacatgacgaatcttacggtaagcaactaggattgcacatcacagaacccatataaatgacagtgggagcaacgtttttgctgaaaatgcaatggaacagtatttgtgaaatgggttaactaagaaatgctgaagcccaattattcaagagtgatatttgtcccttggattcttggaaccaccaaaacctgaccattttgcacactactgaaccaaaagaaaatccactaagcctcaagtaaaaataaaatcgcattcctgctgtatgctgaatccgactgatgttgtttccccaattgcatgatcctcacagggaggcaaccagcattgaagcaacaaatggatcaattcacctggtcctgaaccggcgggcggagcggggatgaggacgtggcgggggagccatccacggcgagctcgacggcgagggcggccgcggcgaggaccgcgggcgacgaagaggaacaacgacgagcctatctggatttttcacattttggtccttttaaaaaatttatttcgcaaatagacctaaaaaaatatcctataaatggtcatttttggatgccagagtggctggggccgtcgtccaacaggacagcgccaacctctctatcgccgtccccccgccgatgtggaatgaactcaaatggacggaatatgtaacttgtagaatttttcctttcttctcctctcttcgaagtgcagaggagagagttgtgtaacttttttattttaattttaattttttgatattttttgcacgcttaggaacacaaaagaaccaaccatataaaaaataaacttaaacggatgaaatatgtgacatatgtgaaattttacaaagctctactaaaaacatgtctcctcgaaaatccagacgagcctctcgcccgagaccaccgccggcgcacgaacgcgactacgctagcctcgggttcggttgggtcggccgccttggtggttctgactgacagctgggtcaaagcgcacgaacgaagggagcgcggcgcgaaccggacggaggaggagaggtgggctctgtagcctgggtcgggccttggtggctctgactgacaggtgggtcaaagcggttgagccgtcgcgtccgacacgggtgtgggtgtggtgcaccgtgcacgcgcaccggaccgacctggtcctcttgcgtggcgtgtgcgcgacgcggagagaaacgattttgtgcctcgtatctgtgggcgtttgcgtcgacgtcgtcgtctactgatgggcgttgggttggatgggaatatggaatgattcctgagcattttgtaccacctctccaggcaaaattcacaagtgttgcaatgttcaagcaaaattcgtgttctgtactatcaaatataagttcgacatccacaactcatgttctcagataggtacagaatttaaagcaactttaggtaactagtgactgatgaggagcttgtctgatggatcacaaaccacaacatacgcaatacaatttaaaacattttctaaagtaacaactaacagtccgggaagaaaacagacactatacgatctaaccatccatccattgatccatcaactcagagcagggtagtaatactaataccacgttccaggcatagtaataacattactaatacagactctaataataagacaagttcacaatctcgatagtagctttataacatttttttgctaataatacagttattgggacagcagtaatactatgttgatcattttctcttcagagcggagaggatcatgcaacggcaacaaagtgtgacatgcaggacagatatcatctccttgggatcttttaatctaagggaactcctcagcaaaccgggtcaaaataccctgaacacaaaaccagtaacaaaaacgtcagtgcatcagaacaggtagcaatttatcattacattacacaagtaaacaagggggaaatatatcctaaacattgcacccccttcagaagcaacaagcctgcaaatacagaaaaaagaaatgcaacttcaatgaaaatgcatccatcacaagtaaacaccataaattgaatatctgctaactcaaatatcactgagttcaagcttcacacgcatatattgggtgacggtacatggaaatgtacatcctgcctgccaatgcgttctcacatcagatgtgttctttgcatagagggaagaaaaaggcagaacataaagcaaatttgcagaaagaaacatgaaaggaaaaacgaactagtgcctgcacactatggttcatatgataacaataaccaaagcgttggcaccactgaaaaggagcaaacagaacaaaacagctgttggtgcaacctagtccattcaatataggcagctcgtgatagatgttcactgaaatcaagtaaccaagaagaccatacaattctagcatatcaatgtaaagtgaattataaaaagctgagctctatttccaacaggtcaaactgcctaaggcctaataacatacagcagcccaggctaaggatgcccatttgttgaggaacagtacaaactgataaaacacttgcaaggacagcagtaaacgaaaaggaatcatacatgcgagtaatgcaatggttgctctttagaaaaagagagcacctgaatgaacaaatgtgaacccatgatacaatatcacaacttacttcgtaactaacagcagaagtttcaataatatttgccacaaaatttaagtaaaataataggaaagaaacaacacttacattgaacagacaaacatcgccagctctggacggctgtagatattatccccatcgtcatccagtgcaggataagcagcaacaagcgcatcttgtgcagcaatatatagttgagttgtagattttccaatatacttcacatactttccttgctggatggaaaaggccttgaaggcagtaattcaagatcacagctggaccaagagcaactctcatcccctcaatcgcctccatgacagcattgatgacatggggagatgtctcaaatatgtttggcaccaagagccatgtgcttcacagcagaggcagcagtttgccagtgaacaagatctctgtccattagagcatcgtcaaccaagggagtaacagcatatatgtaatccttgcccatctcaccaatatactcaaagaggaaagagagagacttcaggacaccattctgaacattgagttctgggactcggtactcattcatcagggcaggcagaactgtaaaaggtgagcaggtttcagcaacaatggcaatcgcgacagtcgtgcagacacggttttgccgttcctgcaccttcaagtaattcaacagagtagccaacacatcctgcagcccaatagccttcgcaatataaccaaatgtgttcacggtggctcttctaatacccttcttgtgagccttcaacatttcaagaagctcaaaacaaatcctcatccactccctagcaggcacaaattctgctccacgatcagcaatcctaccaactagatcaatgcagttctcctggaccttttcatgcctgttcttcaaaataggagtcagtcgaggaagaagattcttgatcagcggtgtcatcttagtcatgccaatgacattcacaatagctttcagtgctccaagaattgaacccaacacctcagggtactcctctcccaaatactcatacagcacaacacccaagtgacccataagctgctcctcctggcaatgtttcattacaatggctatccttgagatcagatcagcagcttgctgcctaacttttgcactcttgttgttcaaccgccacttaatggtaccacaaatctgaggaaggtaaggcttgaccccctgtcccagtgcattgacaacagccccaaaaccattaagcatgacatttgcatcgtcacttgcctgctcttggaaagcatacaagatgccatcaataagcagctcctccaaacgagcatcaatatctgaagcacccaaattagccactaccttctcaactgtttccattaccattctcctgtaaggttcgctttcatctttcagatcctcaacaatcctcccaacaatatcagcaactccaaccttatttgccatctctaccgttgtttccacaagctgcttatagttcctgcggtccagagccattctcctaacccagaagtgatggaaaaattcaggaaggatgtcattccagatataatcagcctctacaccctctgtactgacacactgtttaacaaccttcaggacaatctttttcatctcttcatctggtgactggaactccctaatcaggatttgcatgacctcctttgtgtagtaactggcatacagcgcatccataagagggatgataaaaccaattgctttcaagaaggcagcaagaacctttccacggttagatctgatacccttccacagaggcttcaaaacagtatcaaaactttctataccatatggtgcagcagcctcagcaagtgcagcaagagaaagggcagtgattgtcctcactttctggttctcgtcactaagaccatgctcaatgatctcgactacggactcgagatgtggcagaacagcgcagcccataagaatagcaatctgctgaacaatcttgataccagtgtgccgagcttgccaagacttcttactctgacagacagcctttaagaatggcaggagagcagggatacccaaagcagaagccaccacactaaatgctctagcagtggtatttctcacatactcatcaatgttatcaatatctggtctcatggcggcaatcatagtagcaagaccagcagctttgctaagatttgagatgatctcccggccctcaacacgagcgtagtagtcctcatcaatcagaagtggttcgatgaccacaagaatcttgtgcacaaatggacggactagctcatccagcttatacagtaccctgtcaatgaccttcactagaagatgacgctcctggtcctcaagtgttggctgcatgagcaagggtagaatcttgttgaacaatgggccagcaccaaattcccttgctttgtctgtcagctgtcgaagtgctgtcttccgctgtgggggtgtgccattcttcaccttgagcaggagcttcatgatcttcctctccttctgctcttctggagatagctgctccccctcctcctcattcagcaatgttccaaagtactggtaatcctctggcttcatgaagggcaacccaccaggcaactcctagggcacatcaaactgctgcccacgattctcctcaggaatagcatacaatggtgtgcccaatggtgtcggtgtaacgagcagctttcttgctggtgtgcgtatgggctggtatgaagcaggaggttcaagaatcttgtacccttcctgagggaacatagtatcaagctcctcatccgtaagaggcctgttccgctcctcaatgtcccgctcccaccgcaagagctggtactgctctggagtcattggaccacgagaagcaatctggccggggtgttggcgtcgcaaggttgtcaccaccaaatggcgtcggaccaggagtgtaacctgcaggcgtcgcagcaccagtgcctccaggtgtagcactacccatactagcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggtgtctcatcccaccgattccttctcaccgacggcgtcgcatccccgacacgaccaggggtggcatcccagcgcccaatcccaggagttgcatcaggagcatcccaatcggaggaggtcttcgccttcttggatccagaagcagcagaagcatcaccatcttgcgactgatcccatctattgctgcgccgactggctgctgctcaggcaaggccttcttctccttggccttctcctcttccttcttcttctgagctatatcacgcagcagctgctccttctgcttctgcaggtcattctcgcgcatggcatcagcataggtccgcacggaagggtccggggtggcctcaccggcggcgaagggatgtggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaggaggcgaggcggcgggcggcggggttgacggccgcctcggagtcgtcctcggaggcggggatggaggtgtcgtagccggcgaagcggttggggtcggagccgccgccgccgtagagatcggtgtcgaaggtgacggaggagacggccatgggcgcgccggcggccagggcctcctccatcttcttgcgctcctcctgcgcccgcgcgagctccgcgtcgatggcgtccatggcgacggcgcgggggagaggcggttagggtttggggtggagagattgcacgaggcgagaatgggggaggattgagttgtggttcaagataaaacttcgtgacacgttgtcacgttgatgcgtcatcgggcacgttcggagtaagtcccgggtccacgatacatatgtacgagtttgatacatggcacgtttcggcagagattgtatctatccatctttctaaagatttatacgttgatatcacacacagatttttaatttttagattaaaatctaatagacacaggataaaaaacaaaaaacaattaagaaaaaccataatggacactaattaccatatattcatgaaaaaaaccaaatccaatataaatttcaaattatatgcgattcaaaattacaccatctcttataaaagttatgatgtaagtttcatgaaaatattacaagaaaatatactgtaattttgagtgagacaattgaatgagagataagaaaaaaaaatcttttaagtgagatatagaaaaatcgttttggatatgcatcattctttaaaaaccggtttcactgtaatatcatttttaaacgcgagcattcgctataatattgttttctttttttattgcatttgcaaacatttttgtccaaagcatatgcaatctctctctgaccacgtactcatgatcgagaccgagccgagcgagaggagagaaaggcgagggaagggacgaccacattagtatcgtcactcactagacacgttgccaccttcccccactatccacgaaagatgtggtgaaaggaggcaggagatattgctcgagtaggttgctgcttcttgctgctcctacctctcttgtctcatggcgtggcatgccactgggcttctccctctcgccaaagaaacagacgttgtggtcgtctcccaacaaaaccttctccatctctttcacgatgactctaatggcaccacagatgacgagggagggggcgcagtcaagtaagacggcggagcaggttgtgggcaacgccgacgaggttggggagggagaagtggcagggatggtaagggaaggtggctagggctataagtgggtcagccgcgaacccacttataggtcaaaataagcggtttcgcgacttattttagcctataagtgggtttcgcgggttagccacttatacccctaaaggtggcagcgcagaagacaaatgaggtagcgcgactcagttggggaaggaagtgacgcgctcggttgggtaatgcggcggagttggtgtaatcaccccttcattcagccttctatcctagtattgctcagctcggtctcgatcgtgggtgcatggtagggctgtcaacgagccgagctcgagcgagctcgtctgcccaagctcgagctcgacacaagctcgagccgagccattgcaccttcgagcttttaggcaagctcggttcgagctcgagctcggtgccgagctcggccataagtagtataatatatattttaataataatctcttgataagtataattattttctagttaatcacactaataaaagagtagaaaatgattaaaataaatatattgtgctaacacatgctaatttattgtgtaaatagatacaaatatatatatttatctattagtttattatattaataaggtgaacatgcaatataaactatacacagccaagcttggtcaggctcggacgctcggtagaagctcgagctcggctcggttaagctcgcgagcttttgctcagactcgagttcagctcgtttggagctcgagccgagctcgaatcaagcctaggacgagtcaagctcgagctgctcgtgagtctcgagcttttttgacagccctagtgcgtggtccaaagagagagattgcatatgtggtttggttcaacaacagtaaggggcaaaaacgtccgatgaaaaaatatttgaatgaaaaatattttgtaagtaaaaaaaacaacgaaaatagcattgtgtcgaatgcttacaattaagactgacatctaagcgaatcacacgcaaaattcttaggcactaatgtgggaacgcgaagtaactaactggttaatttagtacataggagtatttaggatggattactattaaatccccaaaaccccgcaccaccgcgtctcaaaaaaaaaaaaaacgcaccaccggcgcggtcggcctcgccgatagagaggccgcgcgcggagggcgaaatgtggaagaagatcgcggccggcgcggcggagggggagacatggaaggcgctcgcggccggcgcggcggaggggtggcgcggtctgctgccgaagacggcgtccgccaccaccaagctcgtgcccgattcttctccaaagtcggcgacgccgaccgcggcgctcaacctcgtcgccgacgcggtggcggcgtggcgccgctggcttcgctctccatcagcgagtcccaccgcgaggtgtgtataccctcctcatcagctgccgtggagggcaccgccggagaaacaagcccccccgtctccgacgcagcgttggaggtgtggcgtcgttggctacgcgcgtcgacgcggcgctcgctctcctcgttcatggatcaagcttcgtcggagactcacgcgcccccaccaactccacggccgtctccaccacgtgttctcccgcctcctccattgtctgctgcacggagggcgaaggggtgtcgcactgctgcttcgtcggcatctctgtcacgcaactactcgacgtcgtcgacgaactcgcagtcccctccggagccccgcgacaggttaactcttcagaacttatataaatgatgcttcctctagcgatattttctctcatgtcctttttaatttgtactctccaaattgccccacatggttcatggcccatgtccaaatctgtggtgcaaagtcagacgggatagactaggcacccattatatgatctgatccgcaagcttccctccattgatgccctcccggagctgaacgaaggaggaaggaggaaggacgatgccgttggtgttggtgttcagagtatctctgactaaatcgcttatctctgaacaagggaaggaggaaggacgagtattgtggatttcctttgggttgggaatgggttgaatccatttttctgcacttggtttgggtttgctctgtgagtggattggattggtttggtttctgcaagctatgaattggattggaatggtttagaagtgtactgtagagacaagtggtctggggcggttctggtctggatctcagtccattagcaggcttattatcatgggtattcagttgaatgcaattatttttctgcttgatgaatcagtggtggacgcaggaaacaactgttgagtcaacagcccaggattttgttcaacattaaattccaatagagacagctagtgttaaaagagttttttctccaatatgtcctaacttaattattggtttgcagctgcagagacgacagatcattggacatatggtatactgctaaagaatttgtcaagaagtatccagttgtactctttgctcagcctacagatacacactctcagttccacagatgggtataccaggagtggttcaaacccacggtaagaagcttgcttaagtgtgtcagtgatcaccatgcttccaatttggagtttcaggagattactacggagaatgtcaagatattttgcaatgctgatgctcctcaatttattccccgaatcaaaatctactgtgagaccagaaaagcgacttatgaagggagaaagcagaattttgtgcagacaggggaactgataacagagttgataaaatcttctgtggacaatccaactgaggttttggacctgctctctgaggacataaaagataagctcagtatgttgaaaaatcctgacctgtctcatgatgctgatccacggcagtgtggagtttatatccttgtgaatcatccgtccatgctacgaagggagatgcaatctccgttttaccttgcctgttatgatttgctaatgagtgtggataaaagaattgcaaacagggcattcaggaaactgccttataagaactggcagtcaagagccctgcaacaccccctgctcaaagatcatctcatcaatagacggtctagctatggcagagacaagtatcaccaagcaagatatcatcggaatgtggcaagtcacaaaacatcatggaaatccaagtacaaagctgaagaggtcgacgagattatccaccaccactttccgatgattttaacacgtctgatgaaggtcctgtcaaagatgaagttgctgatacgccttaccctccacaacttctttggataaagaatgctgtagtgaatctactgcagtagcaaagctcaacttcttcatgtaggaaaggccatagtgatgcaactttttaacaaagctgaatctgcagataccccatgacttcttcggctaaggaaggccactgtcaagctattgctgtaacaaatctgaatctcttataccagaactggtgttgtctgccgcaccctcacaacttcttggagtggggccgaaacaaatgcaaaagcacttcatgcttattacgagtaggttttgtctcattaactttttgttctttaggccccagttatatccaattgtctgaatccctatgcaggttaatttcctgggttcatgtaacaatgcaaacccatgattttgcttcatatcaacatagctaaacatgatatttttctgtcgacatttcttctgatatgccagaaatatatatttttcttttgacttgatacaattaattttccctaggcatgtttgcaaagccttcctgtccgtgtccaagaaagactcgcattttatctaaccactgtacttacacaacggaggtctgcacctgaggtgcattaatcgctagaattactgaatgaactacggtatacagcataagacctttgttacattgtaagatctgatagcgtgacaaatgtttgtgtaaccttataatacagctaaatctttcatttaggctgatgactatgtggaacgcgtcgaatcttcaggtaccaaacttgactgcgcctggagatgagccctcaaaaacaattggtaggtacccagtagctgcgagaatggattctaatccctcgggtttaagttaatctggaaaacacaacatgatagtatctgtgttagagtgacatgccatgaacgtacaaacattacaaggaatcgcaactaacctggcaaaccgaatcacaactaacccggcaaatcattgcaagaagtttgttagcttctccacaagcaggtgtcatttggcccattacccagcaaggtgctccaacaatgcgattctcaacctgcatagttgtcaccaatggatgactcactttaatagtagaagattaagttatggacataagacataacacagtatgaagctacatccattcatttgttaatagtttacctattgacagagtaagggggtcacagagtatagcaatatatcttggagcagtatttaaaactacaggcaagaaaagaacatgaattgatgtcaactagcatgcccagttaagttaaatatgtaacagcgaggtagctgctgcagaacttgaaatctattatattattaaaggaatagaaaaaggagcctccacgttcgctctcaaggcctataaattctcacattaatcggagaaaaagaaaaaacagtgtccatatagaaatacaatttagaaatagctgaaattcagaattaaaaaataaggaatattagaaaaggagactagagtccatatagaaatacaatttagaaatagttgaaattcggaattaaaaaataaggaatattagaagaggagactagagtccatatagaaatacaattaggaaagaactaaaattcggaattaaaaataaggaatattagaagtagagcatagagtccatatagaaatacaattagaaaataatagaaattcagaattaaaaataagaaatattagaagtagagtatagagtcatatagaaatataattaagaaaaaaaatagaaattcagaattaaaaaataaggaatattagaagaggtgactagagtccatatagaaatacaattaggaaataactgaaatttggaattaaaaattaaaaataaggaatattagaagtagagtatagagttcgtataggaatttaaaactaactaaaattcggaataaaaaggagcctccacgttcgctctcatgacctaaaagttctcccattaatcggagaaaaagaaaaaatagagtccatatagaaatacaatttagaaatagctaaaattcggaattaaaaaataaggaatattagaagaggagactagagtccatatagaaatacaatttagaaatagttgaaaatcggaattaaaaaataaggaatattagaagaggagactagagtacatatagaaatacaattaggaaagaactgaaaatcggaattaaaaataaggaatattagaagtagagtatagagttcatatagaaatacaataatagaaattcggaattaaaaataaggaatattaaaagtatagtatatagtccacatagaaatacaattaataaaaaaaaagaaatttggaattaaaaaatattataagtagagtataaagtgcatataggaatttaaaactaactaaaatccgaaataaacataataaaatcaaaagtagagtttagagtccgtataaaaatacaatttacaaacaactaaaattcgaaattaagaaaaacatgggaagaagagtttaaagtcaatataggaattcaatttagaagtaactaaaatttgaaattaaaaattaaagaatattgaaagatgagtttagaatccacatagaaatacaattagaaataataaacattcagaattaaaaaaagaaatattaaaagacgagtctagagtccatataggaatatatataatttacaaataactaaattttgatattaaaaataattaataactaacacgtatataaaatacaatatgaatattacacattagtagtttcgtaaagttattgcaaaatttaaaattatgttatcattgtaatatattttaataatataatgagaaaacatatatgctattatatgagagaaaatataatgatgctagccgcgcaatttgcgcaggccaccatactagtttacctaaaagaaacaaaattagtgatataacatagatttttaagtcaatcattcgcagcagcaatagcagatacactggcaacctccactgatgcagtgccgaagaggctgatcaattaacacgtggaaggaaattgtgtgaaagactttgttcttgtttgtgattatcaaacaatcaattgcccaaatgtttgtgattaacatggtggcatgtctggctacaaagaaatgccaagattttcagacatcaacaaccgaacacacatcgagcagcccaacagattaatgaagacattcaagaatatgaattcgtgttccagcctccctgatgtagtctgcttttctgcttttttctctttctccacttctgtctaccatctatctccctcccccattttcgctttcttctcgcttgctgaaggcggctcttttacgtctgtactaatacgctgctaatcgatttgtagaccctttctccctctctaatatattgggcaatactcttgccgctttcaccttaaaaaaaagcccaaatgagccgtgaagcatccaactaaatataggttatattttttgttatcaatgagctatgaaagagtgataaatacagaagccgtaagaaatcataacattgcaataaaaggaaaatgaggtttggtcataaacaacatacagttttgtaactacgacgctgctccaacttcaacatatgctaattgcctcgcctatatatgctactccctccgtttcacaatataagtcgttctagcatcaatatgaatgtgggaaaacatcaatatgaatatggaaaatgctagaatgacttacattgtaaaacggaggaagtaccatagcttctgcttgatattaagagctaaattgcatatgccaaaataaactattactttatttcccgagaacgccgtcgccggggatggccagccgcttccatttgctcttaagatccaatgttttgacgcgccggtgcctgttaagggaggcattatagacattatatttttcttggtggctgactgggctgaaaatgagaggctatctttaatgggccgggtccacttcgttcacaaaggcgctgggcctaaaacgcgtgcagcccaagaaaacggcccactaccctcaccatctccccccaaccctcgaccgatgtggtgaagtcccaaatttctccgaacattccccacctcaccgcccaaaacccgcgcccattccaaaaccctccgccgccgccgccgccgccgcggccgccggcgaggcctccatggccaccaccacccccgccgcccgcaaaatagccggcaccgaggtccccatcccgggctcggacagggtgcggtggatcgagctcaccgtcccctccaccccgtccccctcaccggagggcgattccgatcccttcgtcctagtgcccccgcgcgccgcctcggggttccacgtcgtctcctccggcgactcgcagtgctatctcgcctggtacgccggtgtcgcctccccctcactgactcgagctccgttggcgttgggttttctcaggaattaatgctgtgttagagctagtggtagggctgagatagctggagtactatggagttttgtgcagtggagttgattttggtcttattcatctggtactttgtgggaatacactgcacactctgtattgcggtggttaactggttgctgtgatgctccgaggaacactaagtctgtgatagcttcagctaagcagtcagttagttgatttgtgcaaattcaatcctgtattatcctgcattgtaccgtcgcactgtagttgagggtaagctctagtgcatttcatcgaaaatatacatgacaccacagggcagtgagccagtgacatactggcatggtgacaaattataactggtacaaccatgatattcaggaatgttatcatctgacagaaacttatgtgctgttatcatctgacagaaagttatgtgctaatagttcagtagagttccttaacgattcaatttttagggacattttgacaaaagaaagtcctatactgtcatggttgatgagacctagacactaaatttctagggacatctgttaaactccttgcaagtacatgagttcatacatttcctacactgttgtcttccaccgatgaagaatgttgaacaaaataccttgtcagatgaccttctattagctagctaataagcaccatttagatgtatttgctttaaagctaggaatatgctatgctaaattgctaatatgacacatttactgctggatgtatttttctttctaaagaaagaagatggtttctgttgcaggaggttccatgaggaacaacaaaatgttctagaggttattgatctctgtgctttcaaggagtttccaagctctggactgcggttggtattccaggaggagctatgcccgttttccttcttatgtgcacgtgaggttggctcattaatgattcttatgtgaataaagtatcatagcatgttaactaattttctggaacatcatttatgtggtaatgcagggcggcagacgtggcacacctgtatatctgctatatgtgcttactgtttctggagttgctctcttatgccacttgcgaagcccattttcctatatctctggttcaatatttcctcaagacgatatagttgaatttaatctccaaacccaagtacagagtgctaaggttacagctgtaacagcgatgtcaggatgcctagtgattgggcgacaagatgggtcaatctgctgttacagtctgggcaagttagctctgaattcaccaggcaagcccataaatgagttatagatggctgtaccttcaaatttcttccaatgttttctgaatgttgcactgttttctgctgtaggtttcttgaatgagctccgagatgatgctgggatcggacgtttatggtctcttgtgtcaaggtacttattttttcctaacagttcacctgagaacatttgtatagcatagctccaccagaaactacatagcctaggagcattcaatgcaattttcatacattgtagattctctttacatgttaatttaggaaaaattaattacatgcccctgcagagtttgctaccctaggatttgccctccccatgttgctaacatgtggtctgaggaccacttgtcagtgatacatggagggagaaatcctagagtgctagcctatgcagggggcatataattgattcccagactgttgcaagtctgggctcagcatattttgttgtgtatggaagcccagtattgtctaaaacttgtctagtttttgtacatatgacaatacatgttgcttaccatttatgtaatatactcctccattgttttttttttgcagaacaaaggctgtgggccctgtacaagatatagtaacagctactgtaaatgaaagggaactgctgtttgttctccatctggatggaagtttgcgcatatgggatatttttaatcacactaaacttctcagttacaatgttcgctcgaatgatatcgaaggtaattcgtggtggctttatgcgcttcaggaaaggtcttatactgaattgctatttgcttatttatgttaatgttccttgtaataagtgttgcgttgacattgtcagcacatgttatgtcattgtttatcatgttaagcaacaacttacaatcaaacagttactagcacactctgctgaaggctcatatgatctgcaagcagcttgcttggtatgttcatagaataggaacaaggaatggatgcatcatgcagttgcactaaattatatcccagattcctaataattggtcgagtgtggtaatcgttggtgatggtagcctggtataaccagctaatcgagtctatttcggtgatttccatgaaatttcttgcagaacaaaataagtatggcaagtgaaaaaaactagaagattccaaaataacagaacaaaatactccctccattccaaaatataaccaacttctagtgttcaaaatttgtcccagaatgtaacaacttctctacctactctcttatctagaccaatcacaatcatatctcatttaatttctcacctacttcttcatctcaagttctcaacagatcacaaccatccctcatttaatttcacctctctccttaatccccatgaagaactccagaagtgcctgtattttggtactgagggaatagctaacatgtggggtctatttgtcagcaatagttccttttaaaggtttgatgaatcattctgaaaattgttagactgtaacagcatttgatgtacgaacactttgttagtgcatcactgaataacaactgcttctgcaactatccctttcttttggctaccctggaataaactggatatgttttacatacttaaaagaaaggatgtatttaagttgttgcttgcactaattgctgtatcttttcttgttcttgaatagtgcattttccattaaagtatttttctatctttaggtcaaccatctaggatatgggttggtgatgctgatgatgatcaagagttgatttttttggctgttctgcgtcaaggcactgtggtatgtcaagaaaaatgtctcaccactaaatttacttggtcatctggaatgcactgatttttcatgctatgccttttcacttgtcagttgactgacttataaaacacgataacagaacctataaaattatgtctgttaaaaatggatacatgctttttgtgggataacatgggggtgaaccatttcacttgtcagctgactgacttataaaacacaatgacagagcctataaaactatgtctgttaaaaatggatacatgctttttgtggagtaacatgggggcgaagttggtacatattatatgcctaatatgggtcatctagagtccaaaataaggaaaacattgcttcatgagtgatgtgttacaccttgtgtggcaaaacattggatcttaagagcaaagggaagtttgatttattaatgtcactggtagagcaagtggagttggacaaataggcgatggtgattgtggcctgaattttgcagtttgtcctggctcatgggtgatttttggaacggaaacaagaaaatggggtggatggaatacagagttgtagagttaacgatctgctaacagattattatttgtgaactcagacattgtatcaatgatgaaacatggtttttctgttgataagacagggatttcctggtcactgattatgtcatcacaatatgctaggtgctaataataatttattgttgtctttgcaataaggtttatttcctgtttccttattaaaattttccttttggtaatcccaccaatccatcccaacagtttccatttgtagatagtagatagcccgttcatcttagtcttctgtttctagatgcagcctcatataggaaactggggcattgaccttaggcttaaaccttagatatcagattttttccgatgttcatgctcatgttaaccattgtgttaattctttttacctattgttgattactccctccgtcccaaaatagatgccgctgttggattcaaaatttgtcccaaaaagcttgtcattttggagtaccttttgtcacatcaatcacctccaattcaaaattttctccatcatacccccaactacctaccatacattacttaatagagggcacctatattaatttttcctaaaccataatctttgccaaataacctagaacgacaactatattgggacggaggtagtatttgttacatgacatggtatgattgaagctgttattctttcagcattgtttttctaagtagctgattaatttacctttttacactgtgcagactggagcttgtgattgcgtttctgtatatggttttagttttggtgctggtgaaaggttcttgttttctcctgaaccttcatttttttctatacctttggtggaggtaaacaaagtcattaccgtattgcattatgatcccttatatttatatatatatggcctttttgggtttctgttctcagaagagacaattttgagtgcctgtagcaacttggtccagtgactatgctacccgctcgtagaggagcaaatatattcaacctactgatgtagagtattttgttttttctcagggaaagcttatcgacttgaaaataagcatggacaagctttggatacttaaggaagttggatcaatgctatatgaaatagtgcagtatgattgtgatacgtaagtatgctgcactgcactgttcccttatgaattgtgaaatgccgctgaccaaatagttttctgctctgactttatgactttttcatcagtgaaccagcacacagtttgtaaaactcaagcctgtatttttttttgcacttataaagattcccattaagtcgtagaaactaaaagttaggtttataattctatattgccaaaaccttgatttcttttataggtcaaacctgcttttgtttcttagccaattttaagtgcccacccttctctctctctctctctctctcaatatgtataaatcctaaacccagaagctaaactgtattaggtcactttatgagtgttcaaatatttacctaaatgtaaataactgcagtgagataatgcattcatatgtgctacaagaagtttctgtcagtgaccagttgtttcaaagctctgagaatacattggatgatttggtctggacagctgattcaatattctcatccaagaaggtaactgtaatttccttgaggttccattgttctaaattgacatgtcatgtacaccttgatgttattattcatagttctagaatgatatgtcaaatattgttatgtacagataaggtcacctattgatctatatgacttctggttcaacttgaattataaggttattgcttcacattgctgttaggtttcttgtcctctgaatggattaaactcctgacgtgtgtttgattcttaaaaatgattactatttagactacaatattcgtaaaccctataattgtcattgatacgactttttagagttagtttatcatttttgctcaattgctgcgggatatatcctttagctatatagatctcatataattattttagttctttgttggctgtgtgaagcttctcaatgttcttcagctatgtagacttcttttgtatctgtaggagcagacattcggttttatttcatctatgtttttgcggaggctacttcaaccaggagtgaatcacagttctgctctacgtgaaaccttgttggagcacaagagatttctatccgattcttatttccaatcacttacaactagtggactacggaaagaaatattatccaccatagaacaagaggtggtttcccttttctttttactcatttctttgtttctatcaggcttcatgatttctagttctagcatgtggcttgactgaattttcatatatctcattcttttagggaagttcacagactgcaagttcgactgcttatcattggaaaaagttttctgcacggtatctccacaattggtgctggaacaataggccatatgggttacttcttgatactaacagagaagtttttggtttaataagaaagggttcattttctctcttccgttgtttggagggcatggagcagtttatttatggtttgttacctttttctagtatttaataattatattaaaattattttcaactatcattatgagctattcggtaacgcctatgagcattatacatcaggttcctctgatgacctgcgcaatcttgatatccttggggtgaacccatcggataatatatctcagtctgaaatcctcattgaagttctaaggtgcatggatcatataagccatctgctggggagatctgctgctgcaatatatcatgaatccctcatcagttctgttatatcacctgatgaaattgtttctcagatcttaaagattctgggcactggtttcagtcctcagtctccctcagccctcattacattatttggaacagatgcttatgcagaaagaaggcagaccgctcacaagagtcagaggaagttttctgttgaaatgttactatcttttcgtaaattgcaatcaaagtcgacatcctggtcagcagtatttgatgtgattgagaacttcatgaagtatttgaacacaaacgtgaccatccaagagtatgagctgaagagagtttgcaatgtgaatactgcgttattggttcaagctacttcacaggtagcaagaacaatgttcgagtccacttttgatctatatctgttcctcaattatctggtctccattggtgggcaggtatgccatatttttgtattttgatatttctgtctgatgtgcatgtgtttacttaactcggccactgtgctacctctgatacgtactgctatatagttcaatattatatttcttttagggaagttcacagactgctagttcgactgccatgctattactcaaacttgctccggttggtcagaactggctaggacatctgcaaatactgattaagatgttaaagtgttcttgacttgcatcaattggaagatagtagacatataaccataagatccttgtcagacctttgtgttgtttgtggtgttaaactgtaattcaatgcttcttcatagatacacactattcttgactggtaaacgtctttcttttatctgtttcattaataagaacaatgtccaaatcaggtctccttgtcacaaaatgatattgccagaataaaactgaagttgttcccagtgattcaagatatactgggacagtggattgtcctccactttgtaggaatttcacctactacaccaccaactattgaggatttcagctatcagctttcttctctccagctaggtcagaacttacagtacattttgttgctctcttacttttacttttgttctttgatatgtattctcttgaatggggacccttcctctacagtatgtttcccgctgtattatgacaaggcaacgagtccatacagataaaaactgatatgccaatgttgggaataattaactatttgccactcttacgagtggttctaaaggatttgccactggacccacatgttggtatgctgtattcaataatggcttaaatggaaagtgggtgcacatgatacttgtctcattagagactaaaatcactagatcaattcatcttcaattgcttaattgctaatgtatcatgttacccatttcatgggaatggcttgacttgacccctaagaaacaatctgtatctctaagttagtttgtttctaatatatggaatgtatctacatggaggaactcaactaaacaatgaaactaattattatttttatctcttattgccaagtaatagcatggcaggaggcccatgggaacagtgcactgcggccacagggtactgttcacacgaaaattttctgcacttgccatgggtctgggtgcaccacaaatgattctaaaatctaaatgcaatgcacacctagcctcttatgatatatgggatcttatattcacacttggcttaatatttataatgccactttcttgtgcttttcttgataaagaaagaacacgtcctcattacttcattctcacaggaaaagctgatgacctgtctttgcacagaaagtttggctgctcttattttacattggcttgtttacttgattttccaaaatctgctgacggggatgttctctcaccctggtttcctaatccaactgagttggtcaacttggtaaggaggtttagtggctcaattatgagtgaaaatattgctggaaatgctgactgtttcttgagttccacaattaatctggcagcagttcttgttcgccatggtcaatatgaagctgctcaggtatctttcttgttggtgccccttaaattcattaaacgtttattgtttgatgtggttctaccattctatttacaataaatatgacaaccattatccttatttcttctgaaagagtcttctgggcattctcgacacacacatgaactatgtgaaagcatctcaagctgaccaggatacagatcttgcacgctcatcatgccttcatctcaatggattttgccttctggtgcttgcacgtgatgaagcaaacattgtcctgaaagaatccaaggttcatgaagctatccgatgcttcttcaggtaccaccttccacactatgcggagttgtgcactgtgatttactgcttaccagaggatattgagtctcatgaagtggtcttagtgttatagattatgtaacattgatatgttacagcaatctgaattacttgtgatgtttctagctgtattattgtataatgtgcaattcagcacttagtgagccatttctcagttttctgttaactaattattgaaaatatttgttattcgataatgctcactgccttactggttctcatagaaaagcctaagtgaccaggcattgagctgatctccagtttattttgctgcttgaattcagaaaaaaaaatgtttgatttatcttgcatcaaagtcagaaaatgtatatctgcatccttaatcgcaaattataaaaaatggctgcttcacacttctactttatgtgttatccaaggttgaacagtggacatatgattatttgcagttatggaagtttctgaaaatcctatttccctaattaatattcagtgcgtaaaggaaaggtcagtttcatttggctgcataagttatcagtatacaaatgcaatatgttagtagtaaattcggcatcacagaactagttttaccagtaaatccaatacatggtttgcaacatatgtactgatgtgagaaagaaatgaatgcggaattaggctgcatatctggtcctttagcaaacaatcaactacttgtgctatcagcttatcagcacagcagtatctttccacataaaatttcaatgatttcacctgatatgtgatattggggttcactgttctccaagcatttcaatgggatgagttcacattctctgcattataaattattccgaacttaggcaacagcaaagttttaagcatcacatcaaagcatatccgatggtcaggaactcaggaccaccttagattaataaaaaacataatcttttcttttggttgtgtggggtgtggtgggagtacaaagttcaaatagaaaattatggggaaaaggctaaaagccttgacaatccactaaaacaaaatgcttggatttgtgtacttgcctaaatttattctcttttatcaatctctttttctatattggtgattggctggctcattaatggtgttaatatgctaattactttgtaaaacagagctgcatctgggcaagaagctccaaaggctcttcagaagttctctgtggaaacagggtttcaaatctccggtgacatcattttcctagttctgcttgtattataattcacctctaccatttcctaattcttttttatttttccaggggaatgcagatcttttacagcatggaggcttcgttactatgagtgggcaatgcaaatttttgagcagcactccatgagtgaaggggcatgcgagtttgctcttggtgctcttgaacaaatagatagcatcgtcgatttagataatggaagtgaagctgaggatatccctgaaactacaactatgattaaagggcgactatgggctaatgtattcaagtacaaattggatttgaaaaattttcaagaggcgtattgcgcaataatctcaaatccagataatgatagcaagtatgtctgtttaagacgtttcatcatagttctttgtgagcttggcgagacaaaggtttgctctgtttatttactgtcttcactaaatgcattgaataatttactaatttaccagttgttttaccagatgtccatagacactcttaggctgtgttcttaactcaaagttcccaacctccactccctcgtttcccgcgcacacgcttcccaaactactaatggtgtgttttttgtaaagttttctatatgaaagttgcgtaaaaaatcatagtaatccatttttcaaggttttttttctaactaatacttaattaatcatgtgctaataagcaaccttgttttccatgcacggggggagagattcccaacctctcctcccgaacacagccttagtggtcatgacacctgtttacctaattaatctgtgggtcgttgcttggtaattgtcatgttcaagttcaaccacaattgattccgtttgcctaatgtttttacgctcttcacaaaaatagcatactatgtgtgatgttggtcggcaggctttgcactaatcattgccagttaaaaatcatataagtatgctattttgtgtattttgagttactcagttcacttcttttactgtgtgcgaaccatgttcactggatgattagagtttaaaggaccttgctatctgttgaattaggtaatttgcaatggcgagataccattcactggcttggtggaaaaagtggagcaagagctcttctggaaggttctctctctccccatcttttgaattacaaaaacttttatttgtgcaacctgtaatgcaatatattttatttaacaggctgagcgctcggatcttttgtctagaccaaatctttacaaggtcctttattcatttgaggcttataggaacaattggaggaaggctgctgcacatatgtataggtatttcgttagattgagtagagagggtaatgctggtggaacccggcaactttctcatacattgcaagagaggctgcatgctttgtctgctgctatcaatgcattgcagcttgttgatccctcattcgcttggcttgattctgtttgtgaagcggatgatcaaatctcaccaagtaaaaagccctgtaatcttttgatgaagaactgtatgttctgttactcaagcactgtttagctggacctttgtacatctcatttcgttattgactacttgtttgctgtttacagctgcttttggcacagattcagagctgtctaggttgaagttttgtgttgacattgaaattctcgaaaaggaatatacactaacagaagcactctatatgctcagcactgtaaattctagattcaacttttcaggtatatgtccccaaagtatcgtgcaaataatttaatattacttgagacttgaatatatatccaagctttggcaatcaatatctcgtgggactgcagataaccaatctattgaagcactgacggatattcttataaatgagaatatgtacgacatggtgttcaccattgtgctgaaatttcggaaggagtcaggaatgaaaaggtgaccagtttccctgtattgatagattcttgcttcttcgtgtcggcgcttctttgcattatctaacttttaatgtttcattttctcatggtagggagttggaacgtgtatttgcagcaattgcgcagcaatgctgccctaatagagtgggcaactcagggtgtgttaaactgtgtttttttggtccattctggttctctggaattgattttagtctaattggcatccactattctattgtagcaactattatatattaataataatggtgccctgccaaaaaaaataacaatgttgtattttatgaccttcttacaggaagaatttactgctgccatcttccgatgatgatgcctgtgatggcaatggtaacagtattgccatggctcatcaatcccaggggagttgccattgggagactcttgaaatatatttggtctgtgctctttgctttttcctatatttaatgtttctctgaaatgagcttcttttttacttaactttgttagagaatcttaaagtattgcatgatactccgactgttctgaaggagcttctctgtcaatttcataaactacaatttttaactctgttctgcaggagaaatacaaagatttgcatcctaggttgcctgtcattgttgcggaaacacttctttacacagaccctgagattgagctaccactttggctagtccagatgtttaaggtgatctcctgatgtatatattctaatagttacaccaactattatctgattgaccactgaccttccatttgtacctttagaccaccaaggctggtaacaggatgatttcatggggtatgtctggcacagaggcagaccctgctacattatttagattgtacataaattatggacggcacacagaagcggccaatttgctggtcgagtacttggaatcattcacatcatcggtaatagatcaacaaactcaaatatccaattgcaagatgtttgcaagcacatgttgacagttacacccttcgaaaccatcctgcagagacctgtggacgttctccaccgcaaaaagatgtcagcggcctggttcccatacactgccatcgagaggttgtggtgtcagctagaagagatgcaaaatgctggccacagcgtggatcagtgcgacaggctcaagaagttgctacatggatctctgattagtcacctgcagcaagttagtactacatctaatggcttcccctttcaattctggatttgttttctagatgtctcctgttgaccacaatctgtttgtttatgggcttccaggttgtggttgattcagatgatgtgctttcatcgcttggaggagggaaaggaatggggagccaaagcaattgagttttttttttcttttgttccttagtgagcgagcaactgagatcttgtgagccgtggattagtgtcagcttactgttgtactgtcatgtgtatgtaatagttgtatggctaatgcctgtgagccatgttcatcacctgtttctgtagacaagggcaattttccatttgtaagtccttttaacacttatgtgaaaaatgcctcgctcctttgaagagtaccaggctaccagcagacacataaagtttcctcgtgcccttttgggtttgtttgatatcgccgttctcggagctcagcgtctggagttatgagggattattttgtacggtaaattatttgataggatgttttctgaaaatttccgtcacagcgttcttatccctcgtccaatccagacagccaaaggcggtcggagactcggtgtcgtcttctcctatcaccctgggaatgactcaattacactcaaaagaatggtcctttttgcaaatctgatgtatgaaaaaaattgtgacccccatcgttcgggacatatacgtaaatgaaaaataatttatgaataaaacttttatatatgatatatgtgtttttagcgatctaaaagcaaagactgaaactttagtaaaaaaactctaaaatgaactctaaatataaagttaaaaattttctattttggctatatgcgaaaagattgggctgtgtgtcttattgcccaatctagaccgtctatttacgatcggacggtcttaaaagatccaaaggatcggcctttttttctccgaccccctgggagtcaggaggggcctttccgctaaacctccggccttttgggccttatcgccttatcgggtatgggccgctcaaacgggtatgggcaaaaggtgtgggcccgagagtgagacacgcggagctctcgctccgcaatgcaacggcatcttttctttctcccctctccccgactcatccaaccgccatcgcacacactgacacacctctccctctccctcctcaccaccaccaccacccccccgcgccccgtgtcctcgccgtcgccgtcctgtcccatcccgtgcgtccttgttaacaatgaaatttggtaagcccaaagttatcatcggcttagagttaatattggcttcaaagttctagaatcagccgataagagttaagtcgccacgatgtcatattcttggtggagtcggatcaatcaaacaaagcttatctacaagagtccgagttcaaaaaaagatgcgacatgacagtttatctattaattaggcatagtttgtaagtttccttttatctttaggaaagtgtgtttagtgtccgataaggactttatcttttcctttttagtttctttcttgtccaacaaggactagtatctctatatgggtataaatatttacacctggggtcattgtaatctatcaatctatcgatcaataaaactaccctcggtgcatcgccacccttttccctaacgtttttacttatcttccagaggaatttgggcacctgacgtaggctgcatcggctttcaatctccagcaaaggggtaagtcctacgctctgtcgggccctggtgaatctgtcggctacgttggtgttgttcaaggctgcatcgattcgatctcttggatcgctctggtttggttgatatatttgcctacttgatatctcaattctacctctaattgcattgtgtttagagacgcatcagtttagttgggactgtctcggttaggtctgatctcctgtcttagccgatatatctctacaatcacaatgtcgttataaatagatttgttatatccatcacattagatagatctatcggctcatcgagtattagattatcatatacaatctcgggctgcatcggttagattcgacctactagattgttgttgataatataagtcttgttaagccgataggttcatgctaatgttttatcgggatgctagccgataagttatctggacgttgcatcggcttgtaaggattgcatatacatataagttggatttagccgatggcaacaaaggtttcactgtttaatctaatcttatggattttatgacattggacctccagccgatgtatgctttaaccttcggatcaatatttgttctactatatcatattgttaatcgattggtttttactgggttatattgctatattatattatcatcagccgattgtctttatatcattatctacattggacatatagccgattgcttaaaccctatcgctatcggctggtaccggcatcggctattatcggctatcgactggaactactccatcggcttgtcagctgatcggctgtttgatctattatttgtatatcttgtcacttgcagaatcaaactgattggcacgcccgcatctcatcaatctttggacctgcacaggagttaagcagatctcccaggccggtgtgtttgattttttcgtcaacagtcctcctcctccctccgccgccgcgcgcgggcgcgtcgcaggtgatcttcccttccgatcccttctcgtggacgaactggttggggaggattgcttgggaggacgatggcgcgcggccgatgagtacgcgcaccacctcctccaccatcagcgtcccgtagacgaacacgcggtgggaagccgaagccgctgccgccatggggatggggtgaaggaagagcagccgacaggcggtcaggcggcaggaggaggatgaagacaactgacgagcaaggagaagcgaggaccgacgagtctatgacaggaggggacagagaccgacgattctatgacgggtggggccagattagctagcaatgtaggtctcgatggcgagatggctaacgggcgactgctagcgttcgttttttttcttttcatctttttcatctttttagtaagtttatacatctaaagtttacacatctaaaatttatccatctaaaatttatagagcgaatgtttataagtcaaaattttatatacccgatttaaattcaaattcggattcaaatattttatatataaaatatttttatacataaagtttatgcgtgcaaagtgtatggtacaaagtatatgtacatgaatgagagtattatatttttttttctaattttcttttactatttttttaaaatttatgatgtaatagaaaagtagaaaagagatatgaaaaaggaatattaggggggagggacgggtgatcgctaggaggagagggaagcgatccctctccctcaactcccggtcttgcccagcccacccactccctcctccacacgcgtcctccccctcccggctcccttccctctccccagtccccacgcgcgccccctcccttcgcttcctggtgcgcgtcccccctcccggctccctcccgttcccggcgaccccacggccccacccacgcccggcgggcctccttcctctcaatctctctctctctccctccctcctttttttttcttctccctcctcttattttttcctcctattctccacggccccacccactcccggtaggcctccttcctctcgatctctctcctgatctctccttccttttttttttcttctccctcctcttattttttttctcatattcttttcttttttttagaaaaaataaaaaaaaattgttgaattcaagactagaacccatgatcccccatggccccacccactcccggcgggcctccttcctctcgatctctctcccgatctctccgtcccttcttttttttcttctccctcctcttattttttccttctattcttttcttttttttagaaaaactaaaaataaattggtgaattcaagactataactctctcccgatctctccgtcccttcttttttttcttctccctccttctcttattttttccttctattcttttcttttttttagaaaaactaaaaataaattggtgaattcaagactagaacccatgatctcatagttcataacaaattttcctaaccaattcacgttatgacactttgtgatttgagattattgttttctttcttatatatctgttcaaattttgtgaacacaaacccgttatgttactgtagaaaatcatacattgttactatgattcggtagtaacattatcgcagaactgcagtaacacgatatagtaacacgacatgttactgcgaaaaatatgggccgttactgccaaatttataggtcgttactgcactcttttagtaacatcgtgatgaaattgcagtaatagagaacatatggtagtaacggtactactacagtaccactgcttctgcatagctaaatttttaaatctcaatcttgtgcaaaatacaagtgctaaaaaagtgcatgtgcatggtcacaagttaacacaagtgctaaaagtatttctctttgtccatacaaagatacatagtagcaagcttagtacaagtaaacttttagaattctaatctttaaacaataatatctctcacatcacaaattattttttagaaccgttttcaccataatgctttaaaacgatgttacaacgagacaatagtcatgttactacatgatgatcgagacaaaaatacttttataatattgttactgcggaaagtagtcgtgttaccacacattgatcgtcgcgttactacgtcgttccagcgagacgagaactaaaaagagataaatctcaatctgtagagagcaatatctctcacattttgtttttctaatccgtttgcactatgatgttcataaaaaaatgcttaacgaaactagatccatcatgactactttttgacgttgttactgcgagaaagttgccttatttctacacgatgatcgtcctgttactgcacgattcgtgcaagacgagaacatcaaactatcttgtttcactcctatataggggctgtgctctgtttgtttggttggtacatgttgtccctccaagtagttttttaaaaaaacaagtccttacaagtagacatgccacaccaaacaatctgacacaaaattgaagtggcacgggagcacctccctggtcaaccaacctgcgtatagtagaatgcatgtccgcaactttttttaacccagtgataccacacacgactctcttcaacaattttattttaaacgtatcgtagggagtggattcgagatgatgtcccctcgttatttgcatgccacttaattaattataaaaaaattgaaaaaaaataaaagatatattaacatgtgatatatcacttcacaaataggcaagttaaaattcaacttctacatctcgcaacgaaaataaattgaaagtgaatatacgttaactagcatgatatatactttttgtagttgataaattttttatttaatactccctccgttcataatataagacacaattacttgtttagatgttccataatataaggcgtgcatttatgcatacaattaatgagcacatcttttccattaaattattatttttttaaaatcctccacccttaagatctctaagtgggtgcatgcattatatttattacgatgatacaaattagaatgtgataataattatttcttggtctttaagttaagggtggttatgtcttatattttattttagaacggatggagtatcgtctagagatccacatatgcataacaaatatcgtataattattttacgaaatgttatatctatgtttcaaactatctgtgttggagataaatactatattaaaattgtagatctcgacaagatctgtaactttataattaatcattttttcatctaaaattattaagagtgtcaaatatacgacattgctactcaaccaatggtcccgactcctttggccctatcgtttcatcaatgattatgtttgtataaacaaaaaattaaattcgaaaacctaattttgtacattttttatcacgctttatttatagcattttgcttttgaattacgatagacatatatataaatttttacctattattgctaataagctacggttaaacacaagcatagacctaagccaaatgacggggacactcgtttgtgttagatggatctccctcctcttgagcccaacggctaaaggtggccttgacctgcgccctgatcgggggcgcgttggtgggcccccgtcacactgcgccatataaaagggggtggaggccggggcggcacacggtacgaggtttgctgccgctgccaactccactccacaaaccctaatctgatcgagagggggcgtagccagtgacgggaaacgccaccgccgcgccacgcctcatcatcgggacatctatgaccgccactgccgcaaccgtcatcgccgtcgacctcaccagcgccgcatccacgacaaccgcgcgacgacgacgacgatgtccggcgcctcttccttcatgaacacctcaaccggtcggtatctaaaccctctcccatccatctacaatgtcgttcatcaatcccaaatagaaccacccgactagatctaacctaggtgatcctagtgcaaagtctaacaatggtatcagagcaccctagcgcttagatcggtttggggaaagaaacccacagaggaaaagaaagaaagaaatgcaaacgatccaacgtatcgaaaagaaaaccctaaccctaattcttacctcgtcgccggccgtcgttgacgccggcacggaggggagaggggcaaagaggcaccgccgaggagccactcgatggccgtgcgcgcacccgtgggtgcacgcgcacgccggtgagggagcccgcggcggcgccgccatctctttcgccgctgtcgctgttctctctctctcacttcacacgggtggagggtgagagacggtggggggagaagagaagagaaaagcacgccggccatggcgcggcggcgcgaaggttgccgtcgacggcgacgctgctccgtgcggtcgcgcgcgagagagagaaagaagagaagctagggttcagtggcggctggggggggtcgacggttttgtttgcccgatctccccgcccggctgtccgatcgaaccctagcggatcggacggccgacggttgggccaaaaacggcccaagaggggcgcgcgtgcgcggcggtttcccggcccaggcccacgttgcggcctgggggataaaggggagcgcccgcgcgcgccaaaatagggccgtgggccgccggcaaaagttcaaattaggtccctcggggggccgaaaatgatgaaaagagggacagtagcaaattttccttttattttgtataattttcatgcaaatttcaatagaattttgaatagttttttgcatgttttacctctgtttaaatttgaaccaacgggagaatttttacagagagtgaattacagagtttctgctactgttcatatgaattttatatagtttttccgctgcaaatagataaaattgatgaaaattagtgtttctaaaattaaatttcgaaccaacaggagaatttaattttaggaacattaattatgtgctatgatgttgtaattttctgaccaacgttgataattgcaatgttatagttatggctatgtgttatgtctaattctgcccaacggtgatgtaggcttaatgcatactattttaatgttaattttgttctcacagtacatgattatttcaggtggctactccttgatgggttgcattaaagatattccgaccctgaaaggagataactacgcagaatggaaaagaaaactcgaccttgcttttatcttgggaaaggtggactgggtgttgactaccccatgtcctatggaacctgctgcacttgtcagaggtgcaaatgagtcagatgctgactggcaaaagagacagagggacaatggtcctctcgtcatgtcatatgacattgaacaaaagaaatggtccttagccaacaagaaatgtttggctgtggtaaagaacacgattgagccaacattattgggctcaattccagagtgtgacgctgtctcagagtaccttgaaagaataaagagtcagtttaatggctcttcaaagacttatgctacacagctgatcaagcagcttgtgacagaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacgatataagtctagagaaatggaactttgaaaagctcattgctaattgtgtgcaagagaaggagagaatcaaagaatcaaatggtggttcaattaattatgttaaagataacaagaaaaagaaccacaagtctcccacctcaaaagctaaacagtctcagcatctgcctcagcaacaacagttcgctgttgagaaagatcagtgtctccactgcaagaagacatgacattacaagaaagactgtcctgacttcctgaaaatgatcatggcaaggaaatgtgaaaacattattacatttgtaaatgaatctcactatgttggttactctagatccacatggtggattgattcacgaggactacgcaaagaagagaaagctccattagagttgccaatggagttgaagaaaaagttgaagctgttggagatctacttctagagctcgcgaatggcttcgcacttttacttcgagatgtcttttatgtaccttctttgcaaagaaacttaataagtgtatcgaaattggatttcgatggatatgattgccgctttggaagtggcaaatgtgaactatggtataataatgaatgcattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaattgagttctcagacttagaacaatgcatagaatgcattaaaggaaaatttgtaaagagcatcaaaaagggtgcaaaacgaagcgcaggaattttagagatcattcacacagatatctgtggtccatttcccgtgaaaagtgtggatggctatgactcgttcataacattcacagacgattactcccgttgtggttatatttatccaattaaagagtgatcagaagcattggataaatttaagatattcaaagctgaagttgaaaatcagcatgatataaagattaaagtagtaagatctgaccgtgggggggagtactatggtcgacatacgccttatgggcaagtccctagaccttttgcaaggttcttgttagagaatggaatagtagcccagtattcaacaccgggcaaacctcaacagaatggggtagctgaaaggcgtaaccgtacccttatggatatggtgcgcagcatgatgagctactccaccctaccactgggtttatggatggaggcgttaaaaaccgccattcatattctcaacagagttccaagcaaatcggtacccaaaacaccgtatgagctatggacaggaagagtaccctcgctagctcacctccgtgtgtgggggagtcctgtagaggctaaagtatttaacccaaatattgggaagttggaccccaaaacagtaagctgccattttattggctatcctgaaagatcaaagggttatcgtttctattgtccaaatagttatacaaagtttgtagaaacgagacacgctgtcttcttggaagacgaaatgattagggggagctcggtagttcgagaaattgatcttgaggagagacgggggtctgtacccgctccgtcgactcaggaacctttcttctctctacctgttgatgttgtgcttgcaatgcctgtcgttgcggtaccggcacctgttgttacccctcctgtggcaacaatgaataaaagtgaggaacctgttctacaggattcaacagaaattgttgccacaccagaggaggagctgcaacagcctcaaatagataatgtgccagtacaggagactcaacaagagcctcagggacaggatgtgccaaatgtgcaggcccctagaaggtctgaaagagtcagaagatcggctatccgtgatgactataaagtttataatatagaagagttgcatatggaggatgatcccacctcatatgaagaggccatgagaagcgcacgctcatctgaatggttggaagccatgaaagatgaaatgaaatcaatgaaactaaacgatgtttgggatttagaagaaattcctaaaggagccaaaatagtaggctgtaagtgggtctacaaaaccaaatatgactccagagggaatatagaaaagtttaaagcgtgacttgtggcaaaaggcttcacgcaccgagaggggattgattacaatgagacattttctccagtctcttgtaaagattccttcaggattataatggcactggtggcacattatgatttggaattacatcagatggatgtaaaaatggcatttctaaatggagatttggaggaaaaagtatacatggcacaaccgaaaggttttgtcatgaaaggaaatgaaaatatgggatgccgtctaaagagatccatttatggattaaagcaagcttcgagacagtggtacttgaagtttgatgggacaataaagaaatttgggtttcaagagaatgtcgaggacaactgtatctattcaaagtttaagaatggaagatttattttcctaattctgtatgtggatgacattctactggctagtagtgatgtcagtctactgcagaaacaaagaaattcttgtcctcaaattttgacatgaaagacctcggtgaggcttcatatgttttgggcatagagattcactgaaatagagcaaagtatgcattgggactttctcaaaaggcatatatagaaaaggtgttgaagaaattcaatatgtacagatgcaatgctacacctgctcctatagtgaaaggcaaaaagtatggggcatcacaatgtcgcagaaatcagtatgagctcaatgaaatgaaaacaaagccatatgcgtcagctgtaggaagcctacagtacgcgcaagtgtgcacacgacctgacttggcatttgttaccaggttacttggcagatttcaaagtaatccaggcccagagcactggaaattggtaaagaaagtcttgcgttatttgcaaggaacaaaaggcctcatgctgtcttacagaagatcagaatcactccagatagtggggtattcagattctgactttgcaaaagataatacaaagtcaacatcgggatacgtgtttaccctgccaggaggagctatttcatggaaaagctcaaaacagactattattgcagggtctactatgtatgccgagtttatagcatgctatgaggcaacggggcaggtgaactggctaaaaaagttcatacgcggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagtacattagaacagaaaggatgctcgcggatccgctcacgaaaggcctaccacccaatgtgttcaaggaacatgtagccggcatgggtttaagggaagccttatgaatcctgtactacagggcccaaaagttaaagtatctatttctaaatagagatgtgtatagtggctgtcgaatccatcggtgattgaccgtgacgatgaaacatgctctatgtgcaaatctgtgatgaaatataaaaaggctaaaagaaatagtgagatcaagggggagaatgttagatggatctccctccccttgagccgtgggctcaagggggccttgacccgcgccctgatcgagggcgcccagcccaatggctggtgggcccccgtcacactgcgccatataaaagggggtggaggccggggcggcacacggtacgaggtttgctgccgctgccaactccaccccacaaaccctaatccgatcgagagggggcgccgccagtgacgggaaacgccaccgccgcgccacgcctcatcgtcgggacatctacgaccgccactgccgcagccgtcatcgccgtcgacctcaccggcgccgcatccacgacaaccgcgcgacgacgacgacgatgtccggcgcctcttccatcacgaacacttcaaccggtcggtatctaaaccctctccctttcatctacaatgtcgttcatcaatcccaaatagaaccacccgactagatctaacctaggtgatcctagtgcaaagtctaacagtttgtgcatgaagaggcaaaacttctaagcaatgctggtaaaaaaaaatcaaaagtggtgttcgagcgacaagacaagtcatagctatccttgccaatagccgtgtttagttttccccttattcccaactttccatcacatcatatcatatcaaaaactttcctacacacataaactttcaacttttttttccaaactcccaactttcttcaaactttcaacttttttcaggaactaaacacacccaatgtgttaatacaagataaattgaaataacacaaggaaaatagttactgtggaggccaggctacctctcccatcatacttctacatgaacaaattgatggttcttttgtcagtgcacagtgtacaccttaaatattggaattgacaagtctccactcctcctgtgcgtgtccaccataatgagctgctactgctcgtgcaatcaacgtaccaagaatcaactcaattgtgctaagctttaatagggtttcatttgcaaatatgcaagtgcacaggataacaaagggtggcataatagggtttcatttgcaaaagcagcatttagcaaacatttgagaatttaataaaacagttaagtaataaataatattaatccaacgctatacaacataccctgttgtataggcccaaccattctgaacaaccatcccggctgcacagttctatctccaaaccaggaatgtaccattccaaaccaggagctaatcaaattattaccaattatagcatcattaactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcttcaataccaccacggtacctcagaaaggagttgtgacaataccccttgcataacacaatccaatacagcgcacctttcctggatcataatcacccccttataaacaaggcatggactccccagcgacccccgtgggcttatctccgccacttctcagtctgatgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccatttccaggttttagttggcacattaattaattaaccaatcacgattgaccatcgtgaactatcatttagccatcattaaataatagtgagtcataagttatcccaatagtgagctaatgtttctaagaagggctaagcaattatatctaatatctagttgaaccaatataaataaagctcaactagtcaaattataataacccaaaggatcaaggaataaagtaatcaagaacaaaaaggctataacaatgaataggttaattccacccaatgacattcaaaaataaatgcaatagttgaaaagaaacaatagctttaaacaggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagacctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacggcggcggttcacgcgaacggacggccgagatcgatccatccaaaatggacggccgagatcgatcggtccacgaccggctcacggcggacagccacgatgacgtcagcgatgacgtcaccaccggcggcggcggctcggcggctcgggcttgcaagctcgccggcgaacgacggcacggcggcgcgaacagaaggcaccaacgggtagcggacggcacggcgaactcaccggcgaccaaagcgacggcggaagaccaacggacggcgacggcgacgaagaagaagcggcggcgctcttcggcttgacgacggcgacggtgctccggcggtctacagcgacagcgaaggggcggacgaggacggcgacgacttggcgaccacgacggcggtcttcccgagcgacggcgacgtctggaacggcggcggcgcacggctggagcgacggcgacgacggcggcgctagggcacacggcgctaaggcgtttccgacgacgagaggcgaaggcgaaggtggcggcgggtagaggagacaccggggatccttttaaaggggctaggagacggcggcgaaggcccacggcggccggcgacgagaaggaaagttcgggaaaaacgaatccgaaacaaactcgaatccacgaatttccaaacgattttagccggtgtttccaaaggagaaaaggtagaggagatcgagaagatcatttcccctctattgattcggctggaaacggaaaggggcggccggattggaaagcggcggcggcggcgcgaaactagggtttcggccggaggaagacgacgggcctgacaggtgggccccacctgtcagcgggcggacgcgcgcgcgcggcggcggactgggccggctgggccgaggagagagagaagagaggttttgggccgactttcggcccaaagccaaaagaagacttttaaaacctttttcaatttaaattatttcttaaatgcaattccatttattaaaaatacttcctcagctcaaataaatcccagaaaaatctaggaattatagaattaagcaaagtatttaataaaattttatctggccccattttatattggaatttattaattaaaattagatcttctcttctaggcttttacaataaattctaaaaattccatttaaacaacaatttatatattttgaattttcagggtgtgacaaggaggactggaggagggggcgcgggcgctggggaggcggggccgggcgcggattaggtgggaggtggagccgctcgtgatcggggggaggtggagccgctcgtgatcggggaagggagggatgggtttggtagttgggctgggggtgttgaatagttattctaagggagaggtgtataacagagagggatgggcttggtagttgggctgatggggggagggggtgtagaatagttattctaagagagaggtgtataacagagctactatatatacacccctcccttagaaccctccttccctcccccacgcgcgccctcccttagaacaatccttccctcccccacgcgcgccccttccctcccccacgcgtgtgcgcgctcgccctctcccgatctcttctctcttcttatttttcctcctcctcccgatctcttcccttttcttttctcttttttagaaaaattaaaaataaattggtgaatccaagactgaacccatgatcttcttttctcttttttagaaaaattaaaaatgaattggtgaatccaagactagaacccatgacctcatggttcataacaaactctcctaaccaattcaccctataacacaatgtgatataagattattgtttgctttatctatatatttgttcaaattttctgaacacaaacccgttatgttattgtaggaaccataccttgttactattattcgatagtaacattattgcagaagtgcagtaacatgatacgtttctgcgaaatttataggtcgttactacgaaatttataggtcgttactacactttttgcagtaacatcatgattaaaattgcagcagcagagaacatatggtagtaacggtactactacagtaccactgcttgtgcacaggtaaatttttaaatctcaatcttgtgcaaaatacaagtgctaaaaaaacgcatgtgcatggtcacaagttaatacaaagtgctaaaagtacttctctttgtccatacaaaaatacataatagcaagtttagtacaaagtaaacttttagaattctaatctttaaacgataatatctctcacatcggatattattttttagaaccgttttcaccataatgctttaaaacgacgttacaatacaatagtcctgttactacacggtgatcgagacaaaaatgcttttataacattgtttactgcggaaagtagtcgtgtttctgcacattgatcgttacgttactacgccgttcaaataagacgagaactaaaaaaaaataaatctcaatctttacagagcaatatctctcacgttatatagtatttttctaatccgtctgcaccatgatgttcataaaaaagtgcttaataaaactagatccatcatgactatttttcgatgttgttactgcgagaaagttgtcctgttactgcacgatgaccgttatgttactgcggaattcctgcgagacgtgaacagcaaattggtgggcggggagggagtcaatgggcgggtttgacaggcgggagggggctttgggccctagggagggtgggggaggtaggattggcccatgggaggggggtgtagaatagattcacaatatatatatatatatatatatatatatatatatatatatatatatatatatatatgctctattatacacccccgccttagaataactattctacaccccccatcgctcctctcctcccacctgcgagacgtgaacagcaaagtggtgggcggggagggagtcaatgggcgggtttgaccggcgagagggggctttgggccctagggagggtggcgtgaacccatatgtgtgtgtgtgtgtgtgtgtgtgtgtgtgtgtgtgtgtgtgtgtgtgtgtgtgtgtgtgtgtgtgtgtatatatatatatatatatatatatatatatatatatatataacaaagagacggaggaaaacaacggaaaaaaagagaaaaaaaaaggcgagtggaaaaaggaaaaaggagccgacgacgggaaaaaaaggaaaaagcggtgaaaatagcgaaaatgagaaaaaaaaagagactgatgaaaaaaaatatgtcagaaaccttacgtattgtgaaaaataatgtgaaggaagatgattggatattgatttgtagaattcaataaattatagatgatgttgcatacttgcataaattttctatataattattgctagtggatgatgagatgtcatgtttacattgtgagcattaggattagtggttataactttatagtaagataggattaaccttatcctttaaggtggaatattttaagaaacgctacatttaaacttatattgtctatttagctaatatatatcctatcttcctatatagttggtacccactaagaggcatttacttctataaagtaagacatgcaagaagtcatatcatcaacaattttaagccatcagatcatattagtacaaagataacaaccgttggattaagaagctacttattcatccaattcaatcatttattagttatccattcacctccctttgctccacctcatagtcacacatagcactattacatattttgtgcatcacacaatgttttcctaatacaactcaaattattgtttaatatgtgtgttttgtttaattatgcatgataagatatcatataattattaggtatcgttatctgaatccatttttagaaaaaacttgagtgaaatagagagttgcaaattgtctaactacaacgatatccatattgcacatgaaaataatattcatatgttataacagtacacaatgatgtttggaaaaataaagaatgaattatattgtaataacataaagcatatataaatccacattatcatatattttgtatatacatagagttgcacctaaccattttaaactatgattttgtttgacgatgaaactacaaaacccgcgacaaagacgcggggtgccaactagtttatacataataattgtaaacaataatatgggatatttgtatgcacacattggccgcattttcaacatgtcttaattatggaaattataaagcattttgtgtttatgtaaccggttaatctatcatctatgccgtctataggtggtgttcttttctcctgaagatgaatattaagtttttttacacaaaacgaggtggtattaacgtatgattgattaattttaattattacaaacttgaaaaaaatattaatatccaatcaactttttttagtgtgcatacaaatatctggtaaaaaacatattaatatgatattttagagcaattttcatatagaaaattttcgcatgaaacacacagtttagtagtttcaaaagcgtgcgacgaaaatattaatttctcatccaactcttgttagagaaaagaacgggatgtgccataaaccactacatcctaaaactcaacatgaaaacatacaacatcatcatccagtagtaatcgctacgttttaaacctcatacaagcatactatgttatctataatttattatattttaaagctttaaaatgcaaacatgttaaatcattatcccacatcatctaaataatatttcaatatatttgcacataattttctacaatacatgattcctatatagttcgttccaacttagtgtgtgtgttttacctcaattgttcctatcccttagataagataatcaatctatggttcaaattatctcacttatttccttctctcatgaagcgacatcacattactcttgcttttagattattaatctatatactatttaaattatcataaaccacgtcaacttactggttttatagctttttccaatgatcgatcttatataagcttatgttgtatagatatcttacacgctatctctacttgttgacgaaaaaatcgaacacaccgacctgggagatctgcttaactcctgtgcaggtccaaagattgttgagatgcgagcgtgccagttagtttgattctgcaactgacaagatatataaacagcagatcaatgagccgatcggctaacaagccgatggagtgattccagccgatgccgattccagccgatagccgatgccagctgatagcgatagggttctgagctatcggctatatgtacaatgtagataatgatatgaaggcaatcggctgatgataatataatatagcaatataatctagtccaatagaaaccaatcggctagcaatgatatagtagaacaagtattgatccgaaggttaaagcatacatcggctggaggtccgatgtcataaaatccacaagattagattaaacagtaaaatctttgttgcgatcggctaaatccaatatgtatacaatccttataaaccgatgcaatgtccagataactcatcagctgaaaccccgatgaaaccattattggcagtcaaaaagcaggctagagattatggttctaagcacgacttagtagatcaaacttaactgatgcagcactaagtatgaaaagaaacacaatatctagacaatcaagcctgtcggtgacatgggaccgggagtatcatgacttagagacttgaggcagacacgatcacccacgtggcctaaccccctcgggggggtcgggcccgagggtgatacggccgctcttctctttgtctccccgaggggtcggaccgctcccgtttcggccccgagggctggggtgccccgaccccttgtggattttacgccgcgtgtatgggttaggtgagcgcagcggcgctcacctaaccgcatttattgcggtttggatgagcgcgtcacgccgcatgtaacgcagtgcagcgcgctcgttcatccggtctgtgatcagtcacagaccggtcaaatcgtgggttaggtggcgacaggcggtctgacgcacgcctcgccccatcccgtcaggacgagagcctccaagcactcgtccctagctggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggtggaagtggaggtaggtatgggccgtcccatcagaaggtcattcggacggcagccatacagatctccgtccattaatgaagaaaagtcaagttggagggaagagaggataagtccccacaaaaaagagagagatggtgcatgtggtatccccttgaggtataaaaggaggaccttgcccacttagaaggggggggatgatttttaggagaaaaaaggatcccggaacgatcgggggctggctcgcactttgtagcttcttcatacacagatccaccaaaacacaggagtagggtattacgcttctcagcggcccgaacctgtatacatcgcccgtgtcttgtgtgttttcactctcgcgaaccttccacactcagaccaggagcttagaatctcacccagggcccccggccgaaccggcaaaggggggcctgcgcggtctcccggtgaggagccccacgctccgtcaaagccgttgactgattttcagggtggtagatgcctaggctaatctaatctagcaggcgatttagccgataccggtagaaaccctaaagcgagagacggccgatagagctaaattgagatgctaggactagattaacatagacatatgataaatagccaggcaaatatattatccaaaccagagtaatccaggaggtcaaatgtattgatgtagccttgaacgacaccgacgtagacgatacaattgcctggaccggtagaacattggacttatccattcgccagagatcgaagacgatgcagccccgcgtcgagtgccaagttccgccggaacgtaaaaacaaaagtagaagtaaaaagggtggcgatgcgccgaattgtattgatcgtgaagataattacatagaccccgggtgtacatatttatacccatgggttgatacaagtccttgtcggacaagaaagaaactatcctaaagataaaaagaaaagataaagtccttatcggacactaaacacactttcctaaagataaaaggaaactaacaaactatgcctaattaatagataaactgccatgccgcatccttcttgaactcgaactcttctagataagcttcctttgattgatctgactccaccaagaacacgacagcatggcaacttgatgactcccatcggctgtttcctccaatcggctgattccaatactctaaagccgatattgactctaagctgatgataacttcgggctttaccaaattttactgttaacactactattatcatattaaactcttgcatcaatgtgcgaagtttcatctagttaacaataaggatttgtgttgagtttgtgcaatcattgagtgctagagtgaagaagaagataaattaggcatgagaagtgtgtattttgagcctacttatatgtgaatatatattaaaaatagtaataatgcaaataagtattttatatatatatatatatatatatatatatatattctcaaaacatatggtttaaaacaaattaagacacttggagtttttttttgtttacgcatgctctaaaacatactccctccatttcatcttataagtcgtttgactttttcctaatcaaactttgttaagttcgatcaagtttataaaaaaattagcaacatataaaatagcaaattagtttaattaaatctaacatgtaataaattttcataatatgtttgttctgtgttgaaaatattaatatgtttttctataaacttgatcaaatttgaagaaatttgactaggaaaaaagttaaacgaaagagcagttttcttgtgaaatttgctaaaataggattattaaaattcattcgtagatctgtaggagctgaatcgctggcttgattgatcggcgatgatttgttgacatggtgtttgatgagttatgaatacagtcgcgaccgccactactacacgctgcgcaacatcgtcgacatgtcccgggtcttccacccgtgcccctcaccagcgtcggcggctactggcggagcgcatgacgtgatggagtatggtagcctgcctcggcataccatgagcttctgccctgcctccctctccaggtggtttggcggcacggagcggatgaggttcgtgctcctcggcggcaaccacaacatggtggtcaccgctgaccagagtagccgcaccgtcctctatgacctcggcaagtacgccattcgcaccctgtctgccttcgtcttcccgacctatctcagggcttcggattcgcttgactccatcaccgccagcatctcggcgacgacctctacatccttcgatacaacccggtcgctggtggttgctaccatgggctcatctacggcggcgacgaggaatggcgctgttgtggtctctcgccgccttcctttcgacctgattcctacgctgtggtcggcgacacagacatattttttttcgtgaacacgcaaaagctttgcacattaatgtattaggaaaagagtagcatacatcggtaacacgtcaaggcgattacaaagaggtaggaaggtacaatatggtgctggagagctacctaaactcagtgtgactcctaagaggaatgtgagagaaacgaagctaagctatgtgactgacagcctcccaataggattggtcgttgcctcaacccatagtcgcccttcttgcataatccgcttcaccatcgttggcactgtgatagaacaccgtcaaaaacacgacattgctttctaaccacaccgtcaaaaacacgacattgctttctaaccacaagtgccagacaaccaggaggataaaggtgttgaaaaccttttagaattatataatttacttgttttttttatattacattatgggacatacgagtactattgttttacttggaaatattatccatagccaaaatagccctggctaaatcacatgccgtcccccttcctcccttcccacccgccgtgctccccggacgccgccgcacttgttaggaatcaagggaactcacgcgaacacagtggacacaaatcacacttacacgtgaagagcacaagaaagaagaacacagcacattgagtattttgtggcacaagcacgcaactagtgccttttctcttgctaattttattcacacttaaacaaatgattacaatgagcagctatttataaccctcgcatactactaatcgcatatacacacacgaagctggttgttccgattctcaagctacacacgacgcccacgtccggtttacttggtcacaactccacaagtatcgcaactgcttgactcagtccgcatctccactactgagtcctcgccgacgtcgttgctcacaccaaccaactaacctgcaactaactaatacatgcaagactaattcaccacataatcctgagactaatcctaatctgcacgcacgcactacttggctggcaatctactttaagcactccaccacattttgtgcttcacgggagattagctctataatgccacaaccactaatgtgtgcagctgacaacttaattagtctactcctacaactaaatgtgatgccatgcaacaaaataaacatgatcacctagtacaacaagattatttctaacagcactcatccccttccttatctgccgccacaccagagctgggttcgtaggcagccaactccgccgcgccgcacccctctactccatcttcctccgcgccatccccttcccgtcgtctttccgccgccggcgactctccgattcgctcgcggccggagtagcggttcggcggctccctccctccctctctactaaggtgagatttgcaacgagaaagatcgtttggcttcgctaggctccttcctgcctccgatgggatatatttttttttattcgctccgatgggaagttttagtccaaaacgaacacaaataaatgcaaccggtggtctatctctaaccctaacccaaatatgcgggagacaccgatctagatagatctcccaacagttgttcgtggtgggggagaagaagagctagggcaatccaatcaatctttagtaagattccttaatttggggggcgatgagtattcgtcggtttgtttatctggtgttggaggagtttgctccccgccgcagcaactacacactgcgcaacatagacatggagcgcttcttcctgccacgtccatccccggtgccattcgtggcgtcaggcaccgacgcggcggagtatgcgagcctgccttgcccagccatgaccttctaccctccattctccaagttgcctgggaaacagcagatggaattcttgctccttggaggcaatcataacatggtggtcgccgccgaccagacttgccgcactgtcctctatgaccccggcgagcacgccgtccgcaccttgcccgcccttccctaccaactggaattgcctactgcttccgtcactgttggggacgacctctatatccttgaccatgttgaggtcggaaacgtcccctgcttccatgggctcatttacgaggatagattaaatgaggactggtgctgctgcgctctcccgccgccgccgccactgctgtcccacaagtctgacttccaagtcgactcctatgcggtggttggtgacacggacatctggatatccacgcacgatagtggcatctattgcttcaacacagtgagccatgtgtggagcacagtggccaccggctggaccctgccatttgttggtctcgccgagtattgccaggagcacggcctttggtttggcctctcacacactagagacaggaggagcttggtcctctccgctttggaccttgatagcagccatctgccagtgcttctcagccttcctctggagttcacgccacccgatgccctcaagcttgtcagctcataccttgtgaacctaggctctgccaagttctgcatcgccaggttattccagactgatgaggaccagcgtgatggcgaggagctgtttgcagtgttgaccgccgtcgaggtggaacgctgcgatgacgacgatgctggtgccaatggtggagggctccgcatgctgaagcacaggtctgagatgtacaagctcaccagtgaaatgatgtattgggtgctttagtcgtgtgggactttagttattgccaagggcctcaaattactgaaccaaagcaatgatttgaggccctactttactcttcctgagctagatcaggaaggataaaggttttgtcatgttcaatagcaggtctgctgtatcgacacaataatacgataaaatggttttaaagggaatcatatgaatatgtgtccgatcttttgagttgtgtcgttgttgttatttgtaatcattttgtgatcagatatggcaataaatttatttcgtttcagtcaattttctgattgttagatttatcctgggattcctgctatttgagggttctcaaaggagaggacagctctcaaagcggagtgctttatgtagttaataccatgtgttgccagtcagtggtgagtatgggggttcttatagtgtttggtgaggcttccatgtcttctcctacacgttcagctttctgccagcagtgagtgatgagtctagtctgactgcatcttcttgcactttgacaagtgtggtcatgctgtgtgtgattttgggttggtttgtcccctatggttatggggtagggtgttgattttgtagtcatgctgagagagtgaaggaggaaggcggtctcgccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcagtctctctggttggcggtagaaagaagttttctccaaagctagggaattagatagagaacggtgttagagagacggagggagttttttttttttttttttttttttttttttttttttttggtgtgtgtgtgtgcgtgtgcgtgtgtgtttgtttgtttgttgagtgtgcacagatgcttcctctgtcctccaagagtttatgataccggatggcaccagcaaaggtggttgcagcagcttgctgtgatggttgccgtagggaccctagggggagagaagaagcaggcctggtggcagtgggaggtcaccactagagggtaggaccaagctgaccatggcagcagcagcggttgtggcttcctaggtcctgggaggcttgcggtgagtatctcacggcagttcctctcctctggcagcaaagctcctcagcaagaaggggaatgtaacgcctgcttgaaggtatctaaaatgcgcttcactaatcactcttctcatgattattgttattcctattgcagtattaatttgcagactcaaaacaatggatttttgcccagttggttggtcatccctttatgacttgttggtgtttgatctgtccagttgactgaagagttgtcttgatgtgtctggaacgttacaaatgtttgttatattacatggcttgccgatatgtgcttgaattcaacagttgctgaatcaatcaaatacaattgagctaaagtttgctctgcctgcaggtactgtctgcttattaggttatattttgtggttgctccaattcctatattgatctaacttttctttggcaggtacttgtcgatgcatggtagcgaataattttcatattttcttccatgctctcgcggggaaaaggatgttaaccaattggcagggactatgattaggtgtgcagagaatatgatgtacacttctgctttatttggaatgcacttattatctagttatatgcatggcacctagacacataaaaactctgctgcctcttagcatgtgtcaaaggtatgttcattagcccttttttcttaggacattaaactcatattatctggttttcttggaacaatcattaacaaattgtactctgatttgatattcaattaaggtgtggttcatgcaaaagaaagctaggtagaggaatttaagtatacaggtttatatttacatggtttttatcattttattttctacagcaaagaggctctagagtgatgctcttcacatattattaggctatcttaacaaaaaagcatcttaacacaacgcttcctcgagtatgtcgatttgtagttcggtcagttcactcaaattcactgacttcatgcatggggactcgaccatcaatcctttcttgcgacgagctgtgactgggtgctctggaacctccttaaaagaaggggcagaggggtaaggtaatcggagtaattacccggtattaagatataagcataataaactgatgcatctgaagacacaatcataagtatgtttttttcttacttttcaattttcctcgtgctgtcctcaatgctatgttctcctttttcccgagaggagaatgagcttatgttttaaagagttgaagatgttttgattcacgttttataagggaactatgttcctgcctcctgatgtttcaacatatttcttgctaaaatgcatgcagaacaactgtttcacttgcagtatccttagaacaccaggatgcacacagatttcccttttacgatattattcaaactgcttactgtatatgctatccataaattgggaagatatcagatgtcctgcgtaccgtcatcattagtcatgttctcacgcaccaatattcccatcctatcaacagtgttactaattttatggttttggctacataaaacttaaagattccaatggcatcgtgcttcctatggaacatttaaagttattttccccttgttttaacattgaagtttcaaataccatcgtgtttctgagaattttttgttatgcttcctttgcatgattgctgaaggcagcagttgcctttatcagctcaacaaacagatatatatgcagtggccttaagacttcctaacatacgatcttgggtatttgtaagatatttgaagatttttcatgtgtgtgttatttgcttatatggaatacaagtatgatttttcgtccatctcttcttgtttgacgcattgaagcatagtttgatgcaaaagaaaaaaaggtggtgaattggttcattgatgaatttctgtgcccttgatgtttgcaggcaatctcttcagatgaatgtgtacaaggttggaaacatcatctggcagtaatttcctgcatgggcatgcatgttgatgtgcaagaagccaagaactagtacatggttactccatgttcggccagcaataatttccatgtacagcgagcagttttgttctacctctttcacaaattagtaatcagaattgaaatcaatacccccacttggaaatagaggtaccctattatcctaatttctctacattgctgttttgttttcgagggtacaggggatgaagttgtagtcgcagactcacagtgtagtctcggtgaactactactgctcccagaagcagcggtgctcagtggcaatggttgcagtaccaccagatattgttttgtacttggtgtcacacatggaagagcagaataagagaatttcccaaaatgaagcgcatacagaagattttgggccctgtttcagcagaaatgaggaatctggaaggggtcgagaagaagattttcaggttgctgggcgcctgtgcccctgtaatgcttgttctgttctgtacctgaatgttaacgatcaaaaagagtatgttgtgttttggtctgttcttttagaaagctggaatccccagcaaaaacatcatgtaccctgttatgatttcaatgaaggctcggcgtaatgctttgatccaaaaaaaaaaaaagaataagaaaaactcagatatgagagtttataatgttcagacaagttcagacattacagtatttcagtatccttctgacgtagaagtatcccatatgttgctaatgtaatctctgaagtttcgctctttggtccctgatattttatattgtccagacaaatcatgaagagagcaacccatcctcctacagtactgatcagccccttgagtactggtactatgctgtatccaaccaaatcatactttcatgagaatcatgaatatgtgtgtgtatatagaaaagcatatgcacttgcacctaaaatctggaatgttggtgtgctttaagatgtgtgctatctaaatgttcattgctctgtacttgtgaaggtttatactagagaggcaaagaaagtggtacataatgtcactctgcctctgacctcactttctaaacttatacatgctttaagatctgaacaggcttatgaatgatctatagattactcttttaccatgtaactactagtgagatagaaccatgtaaccactaaggctattcccaacccatgacactagacatggttttcataaactccacatcatcaagaaactagtactagacattactctttcaatgcaaacaccactattctatgcttcaatttaatgctacttatctcacatgatgtcttagatgttgtgtagaaattatgtctcatgcaagacatgatttccttctctttcctcatttattcacttgccacatcatttttcatcctaggtgacagcttatttaatgctatggacaccatcctagtcattgggttgagaatggcataatgagacgtctcctattgattcatgtaaaagaagggctatgaacaaccacgattatagttattgaagacatatcttctcattgattacataaaaagtaatgatggtaaaagagtacatagtaatatctctagtaatcgataggtcagttggcaaactgtagaagcactaattagactatattatataataaacaaaaaaaaaagcggtacattgtctctatctattatattattaaaggaatagaaaaaggagcctccacgttcgctctcaaggcctataaattctcacattaatcggagaaaaagaaaaagcagtgtccatatagaaatacaatttagaaatagctgaaattcggaattaaaaaataaggaatattagaaaaggagactagagtccatatagaaatacaatttagaaatagttgaaattcggaattaaaaaataaggaatattagaagaggagactagagtccatatagaaatacaattaggaaagaactaaaattcggaattaaaaataaggaatattagaagtagaacatagagtccatatagaaatacaattaaaaaataatagaaattcggaattaaaaataagaaatattagaagtagagtatagagtcatatagaaatacaattaagaaaaaaatagaaattcagaattaaaaaataaggaatattagaagaggtgactagagtccatatagaaatacaattaggaaataactgaaattcggaattaaaaataaggaatattagaagtagagtatagagttcatataggaatttaaaactaactaaaattcggaataaaaaggagcctccacgttcgctctcatgacctaaaaattctcccattaatcggagaaaaagaaaaaatagagtccatatagaaatacaatttagaaataactaaaattcggaattaaaaaataaggaatattagaagaggagactagaatccatatagaaatacaatttagaaataattgaaattcggaattaaaaaataaaaaatattacaagaggagactagagtccatatagaaatacaattaggaaagaactgaaaatcagaattaaaaataagaaatattagaagtagagtatagagttcatatagaaatacaattaggaaataatagaaattcggaattaaaaataaggaatattaaaagtatagtatagagtccacatagaaatacaattaataaaaaaaagaattttggaattaaaaaatattataagtagagtatagagtccataaaggaatttaaaactaactaaaattcgaaataaacatagtaaaatcaaaagtagagtttagagtccgtataaaaatacaatttacaaacaactaaaattcgaaattaagaaaaacatgggaagaagagtttaaagtcaatataggaatacaatttagaagtaactaaaatttgaaattaaaaagtaaagaatattgaaagatgagtttagaatccacatagaaatacaattagaaataataaacattcagaattaaaaaaaaagaaatattaaaagacgagtatagagtccatataggaatatatataatttacaaataactaaattttgatattaaaaataattaataactaacacgtatataaaatacaatatgaatattacacattagtagtttcgtaaagttattgcaaaatttaaaattatgttatcattgtaatatattttaataatataatgagaaaacatatatgttattatatgagagaaaatataatgatgctagccgcgcaatttgcgcgggccaccatactagttgtatttgtaaagcataagacacgagaatgaaatcccggggacttatactgccaaaaaaaactaaaaaaggaggtttattcttagcttccaaccgccttatatttggctgtattttttctttttcttttcacacgcaaccatttcgtccccctccccatttgatttgaaaccaagagaagcaatgcggggggtggtcaggcaccacggcgtcggcgtggtggcgcggatcaccggcggccgcggtgtcgccgcctgccgccactgccgcggccggaggcgagatcactgacctccaccgtcctcctccagccgagggtaatctgctgattgagttggtgcgggagttgttgggcacagccaggtacgaggaggacttcctccccgccgccgctggactacctcctccccccggtcgcctccgccgctgcggcatctcctccgaggacgccgcgttttggcgagccgaagcgcttgtaccaatgcaggtgcgaactctcgattaattgtttgttgccgccgcgccattgccgcccgccgtgccttctccatctaatttaacgcttcagtttcagttattgcgcaatcggcgacgacctaatgcatacttgcgtcggaagaatttactgctgccatcttccgatgatgctgcccgtaatggcaatggtaacagtattgccatggctcatcaatcccaggggagttgccattgggagactcttgaaatatatttggtctgtgctctttgctttttcctatatttaatgtttctctgaaatgaactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaatcgataccgtgttggttaaggtttctatcttgtaatcctgccccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacagttggcgcgccaggtaggggctgcgtcgagttttccgtcgagaagtgcgatggaactttgtgccggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgctgatggcgatatcgtcttcaccgccggcctgcctccgtcgccgccgactggtgtcctcgcctatacggtcggttggtcacaccaccgttgatgggcatcgtcatctacaccgccggcctacctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctggccttcgccgactggtgtttccgcctgcacggctggcctattatgccgccgctgttgggcgtctacgacttcaccaccggcctgcctccgtcgccgccgactggtgtcctcgcctatacggtcggttggtcacaccactgttcatgggcgtccacgtcttcaccgaccggctggccttcgccgactggtgtttccgcctgcacggctggcctattatgccgccgctgttgggcgtctatgacttcaccgccggcccgcctccgtcgccgccgagtggtgcctccgcctacacggctggcctattatgccgccgctgttggacgtctacgacttcaccgccggcctgcctccgtcgccgccgagtggtgcctccgcctacacggctggcctattatgccgtcgctgttgggcgtctacgacttcaccgccggcctgcctccgtcgccgccgagtggtgcctccgcctacacggctggtctattatgccgccgctgttgggtgtctacgacttcaccgccggcccgcctccgtcgccgccgagtggtgcctccgcctacacggctggcctattatgccgccgctgttgggcgtctacgacttcaccgccggcctgcctccgtcgccgccgagtggtgcctccgcctacacggctggtctattatgccgccgctgttgggcgtctacgacttcaccaccggcctgcctccgtcgccgccgactggtgtcctcgcctatacggttggttggtcataccaccgttcatgggcgtccacgtcttcgctgaccggctggccttcgccgccgccgactggtgtttctgcctacacggctagcctattatgccgccgctgttgggcgtctacgacttcaccgccggcctgcctccgtcgccgccgactggtgtccccgcctatacggtcggttggtcacaccaccgttgatgggcatcgtcatcttcaccgccggcctgcctccgtcgccgccgattggtgcctccacctacacggctggcctattatgccgccgctgttgggcgtctacgacttcaccgccggcctgcctccgtcgccgccgattggtgcctccgcctacacggctggcctattatgccgccgctgttgggcgtttacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcaccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcaccgccgattggtgcctccgcctacacggctggcctattatgccgccgctgttgggcgtctacgacttcaccgccggcgtgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggacgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattataaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagaaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacgtcaccaccggctcgcctcgaccgccgccgactggtgtttccgcctgcacggctggcctattatgctgccgttgttgggcgtctacgtcttcaccgaccggccgcctcgtccgctgccgactggtgtttccgcctgcacggctggcctttatgccgccgttgttgggtgtctacgtcttcaccgaccggccgcctcgaccgccgccgactggtgtttccgcctgcacggctggcctttatgctgccgttgttgggcgtctacgtcttcaccgaccggccgcctcgtccgctgccgactggtgtttccgcctgcacggctggcctttatgctgccgttgttgggcgtctacgtcttcaccgaccggccgcctcgtccgctgccgactggtgtttccgcctgcacggctggcctttatgccgccgttgttgggcgtctacgtcttcaccgaccggccgcctcgaccgccgccgactggtgtttccgcctgcacggctggcctattatgctgccgttattgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcgcctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccacccacgacgtctttgtgaacctcgacatctcggcatgcaatgccatgttattttactacaacaagtggctctccaatattcaggatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattactgtcggttacgtttgtcgtcgccgactattttcctcatcttcatgattggtggatttcgtcatcgcctttgatctgcctcgtctgtcaccgactgattatttcgctgccatggctacacaactttatcgctgggcgccttcatcttcattgatggctgacctgactgttgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatatatgcaacatgaattcatgatcatgggtctattttatatgctcaaagactggactatttattattccccgtaagggttatcaactgaatacttgcgccagtcgggattcaattgttatatctattttggagtatcccataagggataatcactcagatcacatggtctatatcacccgggagcatgttacatgtgtcatcctttaaagggtatcgaaggcatattttttggcctaggcctaatatgtttgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggttagataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacatgaacttctctgttagagaatcttgaagtattgcatgatactcggacagttctgaaggagcttctctgtcaatttcacaaactacaatttttatctctgttctgcaggagaaatacaaagatttgcatccgaggttgcctgtcattgttgcggaaacacttctttacacagaccctgagattgagctaccactttggctagtccagatgtttaaggtgatctcctgatgtatatattccaatagttacaccaactattatctgattgaccactgaccttccatttgtaccttccatttgtatctgattgaccatttgaactattagttacaccaaggctggtagcaggatgatttcatggggtatgtctggcacagaggcagaccctgctacattatttagattgtacataaattatggacggcacacagaagcggccaatttgctggtcgagtacttggaatcattcgcatcatcggtaatagatcaacaaactcaaaaatccaattgcaagatgtttgcaagcacatgctgacagttacaccctttgaaaccatcctgcagagacctgtggacgttctccaccgcaaaaatatgtcagcgacctggttcccatacactgccatcgagaggctgtggtgtcagctagaagagatgcaaaatgctggccacagtgtggatcagtgcgacaggctcaagaagttgctacatggatctctgatgagtcaccttcagcaagttagtactacatttaatggcttcccctttcaattctgtatttgttttctagatgtcacatgttgacgacactctctgtttgtgggcttctaggttgtggttgattcagatgatgtgctttcatcgcttggaggagggaaaggaatggggagccaaagcaattgagatttttttttctcttgttcttgaggagtgagcaactgatatctcgtgagccgtggattagtgtcaggttactgttgtactgtaatgtgtatgcaaaaggtgtatggctaatgcctgtgagccatgttcatcacctgtttctgtagacaagggcaattttccaattgtaaatccttttaacacttatgtgaagaaaaatgcctcgctcctttgaagagtaccaatctaccagcagtcaccagacacatagataaagtttactcgtgcccgtttgggttgtttgatggcagcgtatcgccgttctcggaactcggcgtctggagttatgaggtattattttgtacggtaaattatttaatataggatgttttctaaaaatttccgtcacagcgttcttctccctcgcccaattcagacagccaaaggcgccgttattcatgatccatacaaaatagccaaaggcggtcggaagtcgtcttctcctatcaccctgggaatgactcaataacactcaaaaggttcctaaaaaaacactcaaaagaaaggtcctttttgcaaatctccgcccatttggaacttaatgtacggaaaaagatttaagtctttatgaaaaatgctatgcatctttcacccttgtccaatctagaccgcctatttatgatcggatggtcatagaagatccaaagggatcggcgtttttttctccgatcccctggagtggagtcaatgctccgaatagagcgagggagttggagttttcttctccaaacccctgggagtcaagaggggctttttcacaaaacctccggcctattgggccttatcgccttatcgggtatgtgccgctcaaacgggtacgggcaaaaggcgtgggcccgagacacgcggagccctccctccgcaatgcaacggcatcttcttcttctctctcccctctccccgagacaaccaatcgccaccgcacacacctctccctctccctcctcccccgcgcgccccgcggcctccgccacccgcgccctcgccgtcgccgccccgtcccgtgcctcctgctccctccgccgccgcgcgcgcggcgcgtcgcaggtgtgatctccccgcccctccgatccctcctcctcctccgtctactccagatcgatcggtctcttcttcgtcctgcgggaggcggcggctttctcgcggtcgatttctgatccgcacgcgggttctgatttagcggggtggtgtgcatttctttcgatcggcggtgccgtgcattttgtttgggatttgggaattgtgtggcgattattgcgtgtgatttcgtatgaattactgtgttattcctactgtttcgcccaagacaaaaataatagggttaattggatccatgccattataaattttatgattttgaaatatgccactactatttacctatttaaagtcataccattacaatttagtagatatttgagaaataccactgcatacctcttagatgcatagaaatttatttttggaccaaattgcccgtgctttcttcctccatccctttctctctcaactccttttcctcccattctctgcctgatttgatcatctgagttcccattacaagcatggtggagagacctagcgggcaacgtcgaagaagtcaagtgcagctgctagcacggtgccatcatgccgccgcccgccgccgtgtcacgtgagccacccaacaccgcccatatcaattttgagaaaacacgaagaaaaagagaacaaaaatgcacggatgaaagaacatgtctctacatttgcctactagtactatgtacaatcagtaaacgagcttcgagaacacatcagcggccggcaccggcgttgacgccaccgccgtatctcaaatatgtccaaggccgacagccgctgctggattcatgccgaccgggtcagctccgatccagagagagatgggaggaaagggagtagagagagaaggggatggaggaagaagatagggttaatttggtcaaaaacaaatttcagtgcatcatagggggtaagtaatggcacatctcaaatatgtattaaattgtaatgacatgactccaaatacacaaatagtagtggtatatttcaaaaccgtaaaaattataatgacatgaatccaattaacccaaaataataataatgttgagaatcatgtgctcctcgacacgcgtcgtcccgtgttcttgaaatcacagacaacatgggtcgggtctacctaacatcatagtattcctattcgtgggccacgtgtttttttttaccaaatcactgtgcttgtttcactatatgttctgtaaaaaatcgatgattggtaaatactccctccatcccaaaatgtttgacgccgttgacttttttaaaaatgtttgaccgttcgtcttattcaaaaaaattaagtaattattaattcttttcctatcatttgatttattgttaaatatactttcatgtatacatatagttttacacatttcataaaagtttttgaataagacgaacggtcaaacatgtttaaaaaagtcaacggcgtcaaacatttagggaaggagggagtaatagttggtatcaaagctgaccggaaatttgtggtgtggccacaaaatctgtaattccgtccaccgtggcattttcattggcccttttgctttctgactgaaatggttcaaactcctttgaggcactgatgcaacatctgaactgaacacagtgtatagtttttaagtgattttagtgctttacccaagattttaacacctttcccaatttggcaaccatctttgcaggctggtaaaatggataagctcaatggttctgcgcgtctcatgattgtttcagatcttgaccatacaatggtgtgtttctttcaactcataccttggatttgtccagcgctaatcatgacattttgtatatctcattaatgctcaatctttttgaacttttgcaggttgatcatcatgacgaggagaacctgtcattgcttagatttggtgccctgtgggagtctgtttactgccaggattctttacttgtattttcgactggaagatcacctaccctgtatatggaattgaggaaagagaaacctatgctaactccagacatcactatcatgtctgtgggcactgagataacatatggtgaggaaatggttcctgatgatggctgggtggaatatctgaataataagtgggacaggaatattgttgttgaggagacagcaaatgtttccgagctgaaacttcaggtatgttcaataacttgcatggttgctttcttttaatttataaccattttgataatttgatgactaattaataagcaacaacactttattgctgtacatttacatggatataggtagagtcggaacagcgtccacataaggtcagcttctatgttgacaaaaagagtgctcaggaagtgataaagtctctctctgagaagttggagaaacgtggggtgaggaagcatttgtcttgatgtggctcagctttgaataattttttctctaagaaacattcatattttgttttcagtgttggaccgtttcttaagaaacatccatccatgttttgatttcatgtatgattaactggtattgttttgttctcagctagatgttaaaataatctatagcggtggccaggaccttgatgtattacctcaaggtgctggaaagggtcaggcacttgcatatttgctcaagaagttaagctcatgtggaaaaccacccaataatactcttgcttgcggtgactctggcaacgatgcagaattattcagcatccctggtgtacatggtgtcatggtcagtatgcaataaattttgcatgaagtagcgaacaaagttcataacagattgaatgtgtgcttactgcaattacaaagttttttcaaatgtttaggtcagcaatgcccaagaggaactacttcagtggtattcagaaaatgcgaaggataatcctaagataattcatgcaactgagaggtgtgctgctggaatcatacaagccattggacacttcaaactaggacctaatgtttctccccgagacgtggatttcccttatgtcaaggagaacccggtaaagcctacggatgctgttgtaaagttttatgttctctacgagaagtggcgtagggctgaggttccaaagtctgattcggttacacagtatttcaaaaatataactgtaagtatgcagcttctcactctgattttgttctgtaaaaaataacttggtttacttttgtcaaaaatttcctgtcttacctgtttatatggcataatgctttagcttataaggctaaggagcaatatacctcctttggcatgcacatctatttcaaagtttctgagagcattctaatcttgagaaaatgttgtagtttcatctcaaaatgatcatggtaatgacttgttattatagtgactttacaaactaatatattttatttattgtgtgttagcatgcaaatggagttattattcatcctgctgggcttgagtgttctcttcatgcatcaattgatgcattggggtcatgttacggtgacaaacaagggaagaaatacagagcatgggtggacagactggttgtctcacaatgtggttcagagggttggctggtgagatttaacttgtgggagttggaaggtgagtccttagaattctgccaaataactgaattagcctgttatgctgttgtatgcacctttttcaaaataaattagtgttcattttcccagttttaacttgttctattactgtccccttaatagttttctattagatcatggccctcctggtctacagagttctaatttcaacagaaaaatgtgctgcatgatactggatatggtcccactgtactcatttcaatataaactattgaactctcctatcttttcgcttatccacttggtccagacatcccagtcgtctactatttcctgccactaatcctgatgaattgaagaggaatggagcgaatagccaagtgataaccaagaaccacattgatgatgttagaagtatataggcagtcgaattcgtagcaatatcaccatacaactgataagcagtaacatcagctttagtcctttcacaaaatggcttctggagtacattctgtaagtgttagcaaactttacatggcgaacaacaaaatctctgccagttgctctatattttgcaccaccatggagaattgtatggccaaaataatgtgacttggtcccaagatagaaagtgaagaacactgaacagagctgaagctgcatgattatgaaatccccaagggcgcttctgaaacctctttctagtccaatctccataatcattggcaaggccatcaaaagacctagctgcacaatagactgagatcccatagccacttaaagtgcatgattccctctcatccatgcttgcttcataattgcaaactcaagtccacttaatgctaagtcaagtcttccatacaagaaaacatacactatcatgacaaccatccatacaacattaagacaagaacatgagaaaatatgcatgacggctagctgtacattaacaaacaaggttcagatgttcattcaatgaagcgacacatgagttacattaacttgccttgttctctgcactagtgtttaatagagaacacagggcagttgaacagtggacatgtgattatttgcagttatggaagtttctgaaaatcctatttctctaattaatattcagtgcataaaggaaaggccagtctcatttggctgcataagttatcagcatacaaatgcaatatgtaagcagtaaattcggcatcacagaactagtgttaccagtaaatccaatacatggtttgcaacatatgtactgatgtgagaaagaaatgaatgcggaattaggctgcatatctggtcctttagtaaacaatcaactacttgtgctatcagcttatcagcacagcagtatctttccacataaaatttcaatgatttcacctgatatgtggtattggggttcaccgttctccaagcatttcaatgggatgagttcacattttctgcattataaattaatccgaacttaggcaacagcaaagttttgagcatcacaccaaagcatatccgatggtcaggaactcaggacaaccttggattaaaaaaaaacatagtcttttcttttagttgtgcgggccgcaataccttaactttttttttcttttgacatgttcccattatgttatataattagtttttggcatatatgatcctcaactaattgtataaataatgctgtaatgccaggtgatgtgtggtcgtgttgtctgacaagtcttgcactgaatgcgaaggtaagcatcatctatgttcagtccgaaacctatctatgcctcctatacatatgcatacatatcattaattcatttgacatttgtaccatgtaacgtgtttacataaactgaaaaggtgggctaactttgctttctgtttttggtttcatgatctcagcctgaaacccccgagggcttcgtggtaacacacatccacaaaacatggctcaaagggtactcatcagcggatgagcaatcgtccaagctttagaaccttttctgcacctccgtgtgcacatggaaggaatttactcgaggataaataatgaatcttctcttgagattacttccttttcttgtctatattgtcaattttgttcaaaatactatgctggaggattcccagagccccaaattaagtttgacacatccttgtttgatgtgtaagataaatcataaatgttactgtatatctcatgattatcatgagcgcataaagcaaaactacttcacttgaatatatgttactagtgttcttccattcatgatctacagttctgaccagttgctaatgtggagttaacatgcatttatcgagtctagactctagaggctatacaagatgggataggtatgcacaaatcttaagcgaaatcgtgctataatggtccgtttggttggagggagttttcaggagggattgggagtttagagggatgaggctattaagtgttttgtttggttaggagacatgagaattttggtgagataggatggggaattgaggaactcccttattttcaatacctgggtaggggtaggtaattgggagggaattcctcctttcctttgtctaagcaaatctcagccatcgtttttattaatgacctaatctccaactaaactctctatcaatttccatcacctctaccaaacaagatattgggattaaaaatcaaattctcatcttaatcccatcatcaattcccttgtaaataaaattgccccgtcgttccgcaattcttgtcactagtaactagacagtgtaacttaaattttgattatattttaacaatttaacaaatttcaaaatatatgtagaagtaaactatgcgactttcattcacaatcatttaacaattagaaatttctatatttcatcgaaaatagaaaccaaagtgatttatctatatgttataccaacataatcttacattaagatccatatttcgttcaataaattagatccataactctgtcgatcaagatctccactaaggatgaactataataagcattcccaaaatgtaacaaattaggtatgcattctatcttaaattcataatactagaatattatactaataaaatatgttcaatcaaatcttatgctattatattttaggatgaaggaagtagtggttagcagtaagagatattgtgaaactaacggaggatgatactattcagcactgtggtcgttaatcgtgtttgaaatttcggttcgaaatttctgaattttcggcccccaccggcaagcacaaatctccccgaaattttcagttctttgtcaaatatttgtaaatttggtcaaaatttgtttaaattcagtcaaaatctctactattacaaaaattgaaaatgtttttgccagtactttggtacgtcatccgtgtataagttggttttttaagttcgttcgcctttggaaatacaaatccgtatttaagtcgggttttaagttcatttgcttttggaaacacagaaggagttgtataagaaatccatttaagaaaactcacatgctaacttgagatgatcgaactcctaattgtagctcatgattttctagaaaaatatatatccaaattccaagctaattctcatagtaaatttcatcttaactaaactgtataacaataataaaattaaaatagcttttactcgttgcaacacacaaccattttttctaaatattcaaaaaaatcagcaaaaaaaaccaaaatttcggtgattccccttttttcggtctccaccggaaaaaaccaggtttcgaaattgcaaaccatagtcatcaacaatcgaagcactgaaaaagtaatatatctatatctactattataaaagtttaagatatttttgccggagttttttcgtacgtcgtgaaaatttgcgttcgatttctattaggcttgggcttgacttgtccgtgtcacgcagaatccagaggcgcgatggagatcgaaggcagattttgcgtcatgtcttgactcccgatatctcacgtctcagcgtcaccatcttttttttttcgtccgctccgtgttgtctccgcctcgtgtgtcgcatggcccaccggaccgtgcctttccagatcattactgatcatgtttgcagtttgcatcgtcttgcatgcgatggagaaaagcatggcgtcactgatcatgccgcattgctgctgaccgccaagaattgatttgtcagatgagagtttcatgtatgcgtgcatgcagcgtgcactaaagttatagccattagtatggaactatagtttatgcaaatgagttacacatcccaaattaaattaaagaagaaatatttcggtcattactcccaaatctatattttccacttccccggagctaaatttcatgtatcaaatttgcattcagtatccatctatctatacttaattaaaaaaaaatcgtaagacttccgatggaattttcgtctgctactcgactctcatcatctcgtgtcatcacacattgtgccatcaattgttacactacatccgattgaaatctctactattataaaaattgaagatatttttgctggtattttaatacgtcatttgtatttgagtcggtttttaagttcctccgcttttgaaaatacagatccgtgtacgagttggattttaagttcgtttgcttttgaaaatacaaaagaagtcatataagaaatttcttaaaaaaaacttgcatgctaacttgatatggaagtcagattcctaattgcagctcatgattttataaaaaaaaaatccaagcgaattcacatcgtaaattttatcctagctaaaaccgtataacaataataagattaaaataatattcacccgttgcaacgcacgggcatttttctagtactattataaaaattgaatatgcttttgccggtacttttggtacgttatccgtgtttgaatcggtttttaagttcaatcgctcttaaaaatacagaactgtgtttgagtcggtttttaattctgtttgtttttagaaatacaaaaggagtcatataagaaatctctttgaaaaacttgcatgctaacttgagacgatcaaacccctaattgcagctcatgattttgtaaaaagaatatccaagcgaatttccacagtgaatttcaccctagctcatgattaaagtagccttcacccgttgcaactcagggttatttttctattatatatatatatttaaaaaaaaatccgcacacaaaatctccgcgtacacatctcacaaaaaaaaaaagcgcgtaacagggaggtgggccagcctagaggaagtggggaagccgacgaccccacgtctcgccaacacaaaaccagaataatcgccaaatgcgcgcacctcccgcgaaccccgttgtcctcctcctcgccaccttcgcctccaccgattccatttccacccccacgtctcgatcgccggcggacggcggaggcatttccgcccgccgccgccgctccctctctccgtgcggcagcttgaagcgcgcttgcgcttgctttgatttctgatttctgatttgtgagggggacgaggaggaggagatgggcagcgtggggctgaacgacacggtgtcaggggtggtgtcgaggaaggtgctcccggcgtgcggtggcctctgctacttctgcccgggcctgcgcgcccgatccaggcagcccgtcaagcgctacaagaagatcatcgccgacatcttccccgccactcaggtcctctcttgctctctgccaaccgcttccccccgcccctgtagatcgtcatgtcctggaagaaatgcttcgattttaaaacgcgaatattagggaaggacctaatagcaaataattagaagaggtgaggcttcgaactcaggtcgcttagcccaccatatcgtggagctagcctttctcgaaatgcttcgatttttgtaatcccttgggaagattggagcgcggattgcgatcccattatattttgctatatgctcgattattgtcttttgttttttggtttgctcaattcacaaggttgcccttccccttaataggttatagtctccagtttttcgagaaatatatttttagataatgaaagcttgtattgaacccggtcaattacatcaaggtgatacgattcacgaaatatatagtgccatggcctacattgctcatctacatgttctagtagctaatgcctagtggcctacattgacacattgttctactagtttttagttgcatggcctacattgctcatctgcaccgcatgacttcttgttctgcaggacgaggaaccgaatgagaggaggatcgggaagctgtgtgagtatgttgctagaaaccatcatcgcgtgccaaaggtgcggccatcgactccgactcagactttatctattcatccaatttctactgcgctttttattacagaaactctgcatagagaaaggctgttgtgttagaaaaagaagtagtactataagaacagatcatctaaaacatgttgtaaactactacagtgggttcttttatatcggatactcctcttttattttgttgtttttaaatggatatgacttgggaggaactatgtacatggtataacaggttactagttatacttagttttttcttcagacacaacagttattttcattgtgctctaagctaggggaactcttgttcattactgtctgatttgcatgataatcgtcctgtacactcagaatgatttgtagttgccatttgacttccattctcttgcatattgcatctttgcagattacagcttacttagagcaaaggtgctacaaggagttgagaaatgagcagtatggctttgtgaaagtagttgtgctaatataccgcaaactacttgtctcctgtaaaaagcagatgtgagcctttgtttttcacattcagattacattgctgtgaccagtaccaaatatatctcattatatacctgtaaattacgttcaaacagatgtggatttcaaacagaagatactttccattacctgtaaattattttcgaatagctacaaaaatctaaaaactgatttcctcagtgcaggccattactggcaagtagcgcattgagcatcatatgcactcttttggatcaaacaagacgggatgacatgcggattataggttgtgaaaccttgtttgattttaccgtctctcaggtattgcatttgtatagtctgtagcggatgcctttctttgctcaaagatctgtttcaaacagcatcttctgatctctgatttgattcgaggtggacggcacatatcaattcaatttggaagaacttgttccaaaactctgtgaattagctcagatagtaaaggcagaggagaaggataacatgctccgtgcatcaaccttgcaagccctttcagctatggtatgtctccctgcaacctgcatgatattgtttaatgtgatgttatctttgctaaagctaaatattctgctagagttaaggacccttcttagaagtatataatgccttgttgcatcaaaactatacttttacattgtattccactgaaatcatgaggttgtcactaacattgttgacattcagacttgccttctcttgtaatttatagagttgttaatctaataattgcaaacagagttgttaatctaagcatagcaaacttctttcaccaaatatgattcttctaatattgacagttttcattttcttgtattgaacagatttggtttatgggcgagttttctcacatatcctccgcgtttgataatgtaagtggatggcaaaaattgttgaattagtgctgtataaatatgcaaagccttctcaaattgttatgaaaatagatgcacaacggagacacgaattttatgtggaaaacccttgcgggaaaaaaacataggcgccagctagcaatgatcactatagaggaattggatacagacgcaggggatacatttggctgtcgcaccctccccgtgtgacttacaagggatatatataggagaaatctaggagtcctaataggcaaagactcgaagtcctaataggaaactaatcctataatgcggagtcctattagaaaactaatccgaatatattgtgggcccaaaattcggatcacatatttaacacaaatgttgtgacacatatctctctatggaagcttgctcagagtactatttggtgccatacacgtttgtctagagggaaaatgtgggtttcttttggaagcatcttgatatctcaaacttatattatttattttcactatatctgctaggttattcaagtagtgctggaaagctataaccttcaaaagatgcaaaatgacaatatagacagtgaagctccaggcaatcggtgggtggaacaagttcttaaagcagagggcaacgccaccatctctaggataccttcttggaagagcatagttgatgacaagggagagcttcatctacctgcgtaatatgactttctttggtcttttcttacttcatcttgtttcatggccacatgtttagccgactcctgtgctgcagggaagatgccaaggatcctaacttttggtcacgagtctgtgtgcacaacatggccaagctgtccagggaggcaacaacattccgtcgtgttttggagtccctatttcgtcactttgataataataattcatggtcttcccagaacacacttgccttttgtgttcttttggacatgcaaatattaatggaaaaccaaggttctctatttgcatccctttttaggcaactggatttagatatttgatgcgcacatgaaagtgtttactcatttttctttggtttctgcagggcaaaacattgacttgatgatatcaatactggttaagcaccttgaacacaagtctgtactgaagcagccagagatgcaactcagtgtcgtggaggttatagcttcccttgcagaacaatcaagagctgaagcatcagccgcaaccataggtgctataagtgatcttattagacatatgaagaagacattgcatgtcgctcttggcagcagagatttggaggtcataaagtggaacgacaaactccggaatgctgttgatgaatgcatactccaactgtcaaagaaggtcctttactcttgaactgaaacttcttttgtgaattgtgacattctgcttgctgtactttgtcttcatcccttacagaattccaatcagatgcttcctagtgtggtaataggctgtataaatttcattgttattggattataatggtaggaacatacgccttactatgttggtattattacacaggttggtgatgctggacctgttcttgacatgatgtctgtgatgctagagaacatctcccgcactccccttgttgctatagcaaccacatctgccgtttatcgtacagcccagataattacttctatcccgaatttgtcatataggaataaggtatgttgtggaaacacaaatattaaatttgaatttatattatccagcaacacttgtatttgtttggaagctcactctccatcatatttttcaggtatttccagaagcactctttcatcagttactcttagcaatggttcaccctgatcatgaaactcgtgtttctgcacaccgcatattttctgttgtccttgtcccgtcttctgtttctcccttctctaaatcaacatctccaaatcagcttgtgaagcatgatattaagaggactctctcaagagctgtctccgtcttctcgtcttcagctgctttgtttgataaattaaaaagggacaaagagtccttcagagaaaaaccacaggatggaagcatgaacagactttcgcatgctgctgacaatgatacttctacagtcaaggacatgccaagctcgcgaagtcgaaggcacagcttcaaagttcctaatttttctatgaaaagggttgcttcattgtctctgaaatctcccatgtccccaaaggaatgccaaaatacctcggccgaatcatgtagtgaaacggtattctcgtgtggaacctgatctcaatctcgttttcaatatttaacaagctagtaacatttgagcaaaaggaacatctatttaactatcttctgtgcactttcaggaatcaactttgttgagactaagcagtcgtcaggccacacttttgctgtcatctatttgggctcaagcaatttctcctaaaaatactcctcaaaattatgaagctattgctcatacttacagtttgcttctgttgttctcgggatcaaaggtacttcttgttatgttgtattatccaccttacatatattcttaaatgtttccagtcaacaaaactgtaaatttgattatatgatcatatatgagaaatttatcatgctgcatgtaacatccttcattcctgtccatattgctgttattctctatccaagactcatttgtaatatttgtaatggtctttccacatctaatacttagcttcattaccctgttttatcatatttttttatgttttatctttttgctcttccaggcatcaatctttgaggctcttgctccaagttttcaggtggcgttttccttaatgagttattcactagaaggaacaggtaaggtggttaatcatactgtctagcttcagtactgatactatataagttcttaactacccacataggatgaaactctagtggatgatatcttagctattactaaagtacgactgagttagttccttgataattacctaaccattttaatcttgctttttagattcattgctgccatctcgccgtcgatccttgtttactctggctacatctatgattatgttcttttcaagggctttcaatgtggcacctcttatcccgatctgtaaatcaatgctcaatgaaagaacagtaagtctgataaaaatgtctcatctcttcagctcttctttttgtataatttgcctggtataacagaatacaattgttttttcaacaattgacaattttgaggaggcatttggtaatacctacatggattgtaccattgaggcatcaaccatacttaaatctttccatgttgattttctaacggtgtttgttgctttgatatatgccctctttatttaccatacaaacttaatagctaaactttatgtattgcttttgttggcagatggatccattccttcatttagtacaagacaccaaacttcaggctgtgaaggactgctcagaagaaacctatggatcaccagaggatgataataatgcactgaagtctctttcagcagtagaactaactcagagtcaatccagagaatccatggcctctacaatcatgaacaacataagagatttaccagatgtaacattccatattttcttccaaaggatctcttatattgtttgaatcttgcttcagaatagaaaatctgtttgaagcaaaccctatgcaaattttactgacaattatttccaacctctgcagtcagaattacaaactataagaagtcaactgctaagtgacttctcccctgatgacatgtgtccaacaagtgctctcttttttgaattaactgtcagaaatccaggttgtgatgaggattctagcaatcaagaggtaatatgaatcctacgtattatatctttcttttgttcttcttctttttccatcctgaccactaggaaatgagcaggatgtgctgatcaatatggcaaatgacaatgacacctttggggaagtctacgaaaatacagaagctactacagcatctgtgcccacagcaaatcttctgggtatcgatgagcttctagaatcagtacgttcttcttgtttccatctatcactcccctccttttttgctcttatgtactagtatatatttaactgattgaactttagcgtgattttagccaaaaatcgcatagtcagaccatgaagaagtactgaatttttagcttctctctttcatgtggctgaagtaaagaaccaaaacctaaggcaaaaactgtctgacactgacatgatcaacttatacctgtacatgctttctacaggttgtcactgatgcaccatctcagactgcaagatgctcggtgtcaacggcccccaacatcccattcaaggagatgactaaccaatgcgaggttctttcgatggagaaacagcaaaagatgtccgtgctcctgagcttcaaacacaaaaaccaatcaaatgtcctgccgatcaatcaagctgacaacacgggagcagtccatatttcctctgacgaccaggtgcctaagttcagaacaatttgcttgatactatcatcttttcctctttgcccattttaccaatgcatatcagtctggaatcgggagaaatgaaacaaaaactacaagtatcatggaatgggacgcatagattagttttactaattcttaaaccatcttgtattgctgcagaatacgaacccttttctccagcaaagccttgatggctaccccaaatatgttgctgatggtgaggcactacaggtagcagctgatgatgtgttccagcagcaattcttgaagctgccagcatcaagcccttacgacaccttcctcaaggccgctggctgttgacactccaggggccatgctgctaagacaagacatgtactgattaattgtggacactaaaaagtctgcaattgtattgtaaccagtgtatgagtgcagcctcttcttaattgcaagatgtaaatctcctcctattgtcaatttgtcatgttccgatccaacggctgggaaggaacatcgcattctccctgcttttgtttgtgcaacggtagaggaatagtttgagaagttcaaactatggtacgaaacacataatttaatccatacaaatcgataaccttattttcttcttggtttgatcgtgccgtgtcatgtctacatgtcggccaaattttgtttggctcaatcttataaagatgttaataaagatagatgtacatatttacgttcacaggaataagtgtgtgtaagcgtctacctttgtaccgtggaaaataaagtttcgtggattgctacacatgcttttcttttaaaaaagtttgcaaaacttttatgaacaaaactcttatctatttgatttaattaaacgagagttcaaaatatctagatttacttataatttgcgaaatcattgttttataaaaattctctaagaaacttcacgtataatactacagccttttccttcggattaaacaagaaacggcgagacgacgaccaagtacaatagccaccttaccagatcgtgtttagagaaagagaagaaaaataatcattaattaatccggattaagaaacaggagagtgggtgaccacctaatgctcctctccttgtgccgtccgtacatcgtgtgacgatttcgtacctggcgtcgtcttctatccaaggagaaaaacaacagagcacagaattaatattaatattaatattaatattcctttcgtaccatttcgtcctcttccggccactctgtcatcaacgtcgtcgccaactcacaacacggatagatttcatgttgtttatattatctcacaaattctctcttggactactaatactatatatttgatcttcttccgtgtggggtcccttcttgctctatgctaattaatggtaaattaactctggcacgattttttttattgcagttttcgtcggattacacaagtgaatgggaagtgataaatccgttcatacatgcactaggaactagttagtcttaatccatgtgctaattgtgaaagttcaggttgagtttggttgtcttgtttttagcctagttaattgcttacatcacaggctcacagcacataaccttgcacatcatatctaaggttagtttcacctgtgtacttgcatagaactataaaggccggtgctaatcttgggcctttaaaaaaaaatcttagcaggtgaattttaaacagagcaattatttatggactctttaaggcaagcatggtccatgctttttcagaaaaagcgggttactcaaccagcaaatctgctggaacaacacctagcttagctagtactacagctaatttgacattcattcattcctcaacaaaataaaaaactaaataaacaaacagacccaaatcattacagtccacatagctccaaatctccagcttaaattagcgaagatcacctaattaattaaacccaagcacacacaccaccccttcctcatcggccactgacaagtgggccccaccagccatctcgacggagccgggcccacatgtcagtgggacaccccctaatatgaaggaatggtcaaaaaaatgcagacgtgtatccaaataaaaacagccactatgctacaaaggctacagctttgcaattctgaacaaaccaaaccaaaccaaaacaaaacaaaatctgccgccctcgaattctcgatcgccgtactagtataagaatccccccatcctcgatcgatcgatccatcaccacgaagattacggaagatcattcttttcttgcgagaaaaatctgttcttgggagagaagatttgatctttgatgatgatggggtacttccgggcgccgaggaggaaggcggcggcggcggcggagggggagagcgtgcgggcggcgctgctcgtcggcggcggcggcgaggaggcggcggtgccgaaggggtacttcgcggtgtacgtgggcgcggaggcgaggcggttcgtggtgccgacgagctacctccggcagccggcgttccggggcctcatggagctcgccgccgacgagttcggcttcgcccaggagggcggcctccgcctcccctgccgcgaggaggacttccaggccaccgtcgccgcgctcgacgcgcgccgccgcccggcgagcggcggcgcgatcatgagcaccatggtcaaggccaggtcgttgtagccactagcccgccataggagagaaaatttccagaggaagaattctttggttgattcgatgtggctcgatgtacacaacacaagcatggtgatctgatctgatctgatcgatcgaaatcgccattgttcatgtactttgatgatgcgtgtgatggagcggtagatagagtggtagaaactagaaacgatgaaaaattactgttgattctgcaaaagactctgaaactgacatgaaaggtggaaaaaaaaaagagttgcatcctgatcttatatatatcctctctctggttaatcagaagctttaatttgatcataaacctctcattcttgattatgaatgaactggaggattgatgttctgcttcatcaatgaaggttttgtgctgagcttgcctgcaggcttgcagcatatctcagttcgatgcatatgagcaattattttatttgagttaataattattatgtgtggatcatctgaaatgatgatcctagaatgaagtatgcatgtgactggatgatcacacttcaaggcaagtagtaattgttttcatttaaaaatctcccctctttttttctccggttactgatagaagaacagcatctccacaaatggcacttccagaatgctaatgttcaggttaggttctgcaagatatagaagctgtctagctctttccagatggcacctcaatctgttctgaatgatgtccacgtttgttcagaaaatagaatgcaggaggcctaccatttccttcttttttctgtttgcaacaagatttgtacttgcagctggcacaactgaaacaggtggcgcaatataccataccagtggttaacttcaatactttcttttgcgtgggtgattaactttaacaatgtgatcattcttcaaatacaatgtcattctcaaagattgcatctgacaagagggcattacaaggtaggagtagatctttgcatgagactagcatgatttttgtggcttctggttccaggcatttcaatgttgcatctgtcagagcacatgtgcaaaaagattttatgctatgtattattgttcctaatctagtgcccctgccatgtgtaactgtacggcatctttcttctctggaactctcatttaactctgaataataatatagtctaggactaaaggacatgtcatggcattccttaatggagaggaatgaggattagtcgaaggtactagtagacatagtacatgtgtgaagcatccaacaagagagacaatactaagttacattaaaactccagagaatatagagattagtgagttcagaaagagcatgtgtcaagaagaaacaatttagcaagagaggcactaaaattcagagggttgacttccccatgattcttgcagatctattgaatgattgtgttgttaatcaggaattcaggattgaaccagtgagagcttcctacatctgaacacatacttgaggattcagagatgagttgtcatcttgtcattgaaagctaattttaaacaaaaagcatcaaggtgcaatgacatatatattgagagagagaaaaaaaatacaactattaatattacttccttgagacacaagttcaaatagcacaaatgaacactgttcaacttcagaacatacaaaatgaaagtgaataacatcgaacaagcgggtaaagaattatcaacaaagaataagtttacctaagatactttttttagataatgtgaatccttgattttttttcctctaaaaagaatgtgaattcataacctcatcctcttgaacaaagtagcaaagctcagcaactccaaactcttcctcctcttctcttcagaagaccaagaaccaagaaaacaacagcaacaaagtgcaataacaattgagtgcaaaggggagaaactaagaaataccatcatctgcacaagatctcatgctctgaagaagagtagcacattgctgccttctcatccttcctgccaaccagcctcaagataccctcaaacacctcaacatcacatggaatcctcagagctccctcatgctggaacccaaactcctcctctgccttcctgagtagctgctcaaatgcccagtggccaagatactctgtggggatgacaaacctcctcatctcctccccgacgcacaccgcgaagaaccctttcgggaccgatgcaccgccgccattgttgttcttgccggcctttggtgcaagtgcagccctcttccacctcttgagaagctggtgcagcctcacaatgtccctgatcttgttgctgcttgccctgcctccttgctctcccattgttagtgcttttgtgtttatcagattgcttggtgcagagaacaatgtggggggagactgacaatatataggtgtttagattagtgtttagttgcagctaagtttgttccttgagttagtttgaatgtactaatcaatggtttgatatgatcccttttcttaatgtttgaggcctctgttcttaatgttgatgttcttagcataataaactaaagcaattaagggaaacggacaccactagtttctgagggttctttcattgtaacacataacctatattgcatttttccccacgaacgcacaaaaggattacacgttatttcattagaagaaagcagtatgcataacctatagtgcacattgaaattggaatcatttctttctttctgcagttaaatcagcttgaatttacttccttcaacttcattagattgacaaaattatattccaaaaactagattgacataataaactatatctggttcaaggaaaagaaagaataatgctaaagtgtgaaattggtgaaagattcctgacgtttcgtacacggccgttggatttcttttctgaataagttgttctttcaatatcatgtgaaaaagctgactgcctcctggagaatgcaaagtgtgatccaactgatgaaagattccatcaccctgcctaatgatgagcaaagggccaagagatgcaatcaacacctactctagtcagtttatcagagcaactaccatgcatgatttgcctcaatctcatcattgctgagagccaaattagacagttcatggattggaaaaggactcctctagtcctagctttaggtagcatcacaaactactcttgaaagtttcagtgcctgactctgaaacaaaaggtgtgtttagtggtttagaatgtctctttcagttttctttatgctgctgaagtacttctactaatcattggcaattatgcacttttctgcttatgtttgtttattaatcctctgtatcttcaaactaatttgggggttattgggtcaatatcagttatcagacagtcaaacttgataatgtttcatatttctcatgcttagttaggctcttgagaatccacttccagaaaactgtccaataaccaaggcagattactcttaaacctctgatttctcatatcttcgaactagtcatgcttctagaaaaaaaaaacaattacgtgtcatgtttccagcagtaaactgtccaatgaccaaggcagattactcttaaacctctgattacatacttttctgacaccttaatttaacttagatttgtattttggcttgcatagattcacgcaccagggtttaatttgggtttcaggtacaagaaaggacaccaactgctaattaacctgccatgcatgcatctgaactgaagcaatgtcaggttcactaataaacacgtcttaaacaaaatagagatactctcaggataaaggactccaacttaaacaaaacaaaacctgtggccaaaaaaagtcttttttttttgcatcaaatgcattactgaagaacagaaaataaagcatccgagcagagcgaagcagatatgaagtaccatagggtcagcacgctatttaacattggcatggaatgtaaatgaatgtcattttcacctccatactcacaaacatatgactggtagaccacgatgaacactggtaaatacgtttactcaatttctgtgacatataacttttggggggaatacacaaaaagcttgtgtaggtttgtattaagatgagtaacagatgataagtatcactttcataatcattttccaaaatagtaggtacagatttaacttttactgaaataatgcccactaatatgacaatatacaatgacaataatgccattctagtgtttgttatttgacacaaacagaaatgtgtcgataaaattcgaaacaacaatgtttgggttgctcagctgtcagattcatgaaaagttatcaacttccaattatatgaagggggtgttctgtctgcttgcatcaactacgatcactttctgcagtgagacctaccaaatctatgcaaccaccaatcaggattcaggaacttcagattagaaactttaaggaaacacgcaatgatcagcatgatcaagacatcatagtgtctttcagataccggtgacccaaaacttcagactaaaggcttgtttggatcagtgccctaccaattttttggaagttttggcactaccaattatttggtagaataaatttgtattcatcttatttggtttgctaccaaaatgtagccaaattgtgatatcatagtgaagaaagttctagattgctaccaaatttaggatgggcattaccaaaatgttggcatcagtccaaacaaatggcgggtactatttaggctaccaaaatattggtagggcaaattttggtagcaatccaaaactacccaaaaacctttcgagtatctttacgatactctctactagtagtatttcactaccgtggtagaactagaagtgatctttttcgttcatttatgagtactactattaatataaaaaacattctactctgcagttgatgcggtagtataaatagatatgacccattaatttaaaaaactaaactgtctagattggttcacctaccattaaagaaaaacacctcaaatctttaaggttgagatgaatggtgcagctagaagaatgtgaaggattaaccaaatcaaagtttaataaaacactaataagtaggattataatctactacttcctccgtttcacaatgtaagactttttaacattgcccacattcatatagatattaatgaatctagacattattatatacatagattcattagcatctatatgaatatgggtaatgccagaaagtcttacattgtgaaacggagggagcggtagttttagagtacatgagtggggtggtattgaccgaatctataacggcacgacttgtgcttgacgatgcggggcttcccgccatggccgccgccgggcgccacctcgacgccggtgagcatggagaatttcatcttgtcgtgctcgccgacgcagcaagggtagctgcacgtcccgcggcgaacgacccagaacaccttggcgacgcacagcttgccgccgccgaggtgcacgacgtgcgacgcgacctcccgcggcgccgccaagcccttccactcgccggggctcgccaccgagaaccccttcgactgcacgctcgccgccggcgcccgcggctgtggggacgcggacacgtcccacgcggcgaggacggtgtcgtccatctccaggaagccgacgcagaggccgtgctcggggacatgctcggcgcggccgcggaacggcagcctccagtcgccggccttgctccacgccgcgctcgccgtgtcgaacgagtaggtggcgcggtcggtggacaccaggatgtgcgagtcgccgatcgccgcgtacccgtggatctcgccggcggcggcgtcgtgcacgaacggaggcggcggcatggggcgccagtggcgcgcctcctcgtccgcattcgtcatccacccggaacggcgttcacggtggacgagcgcctcgaacgaatactccggccgccgtccctcgccgccgccgaccttgtcaggatgaggtggcgtcaccatgacgtacaggtcgccggcgacggcgagcgacacggtcaagaacttgggcgatgccatggggggcaacgagcggacggtgtgcgcggcggggtcgtagaggatggcgcggcggccggtgtcgtcgacggtgacgatcttgtcgtcgctcgtgcgcatgaagttcatcgacgcgctgaagcccatggcggctggaggcaggcgagcgtcctccaccgccgccgccgccgccgacgacgacggcgacgctcggggcagttgatccttggggtagaagagacgtgacgtgtcgatgcggcgtagcctctgggtgagcgagttgtcgccgcagaggtcgaccatgtagaggaaccgccggatcatcgtcgtcgtcgtcgcaaagccggccgggttgccgtcggtggagctcgtccggaggcaggcggcggcggcggcggcggtggggcaggacagggcgaaaaccgagagagacgcggagggaaggaagacgagtccgtccgtgcgcagtacgtgaacgttgaccccgtttgctcctgttgtgggtcccacttggggtacaagtttttcctttgggggaagtttttaaaaagaattgaaattttagagggataagactgcttcgtttgattagaagatatgagagttatggtggaatagggatggagaattgttggaaaaactcctttctaataggaggggtggtaattgggaggaaattcctcctttattttgtctaaacaaaatctcaaccatttattttttatttaagatttaatctccaactaaaatccctattagttccaaccatctctaccaaacaagagtttgggactaaaaataaaattttcatattaatttcatcatcaattcactcatctaactccctattatttttcctcaagttgttaaacaagctgctatagcaatttctttttttaatacttatataaattagtatattatagttatagaatagttacaacgaaattatataataactactctctccgtattttaatatacgacgccgttgacttttcgatcaacgtttgacaattcattttattcaaaatttttgtgcaaatatgaaaatatttatgtcatgcttaaagaacatttaatgacgaatcaagtcataataaaataaatgataattacataaattttttaaataagacgaatggtaaaacgttggacaaaaaattaatggcgtcatacattaaaatatgtaggtagtatattataattagatctgaaagttttctactaaaagaacttaccacagttttaccaagttttccactaaaagaacttaccaagttttacagatagtccctagtatttatttagtgttgtttttacattaagaattgtgtttcttaattagctagcccaacacattaagaattgtgtttcttaataagctagcccaaaagtacgagagagggccaaatcaacaagcatactcctctttgtgtataatatttgcaatcaaatttgttgtatttattcgtatttatataggtaaaatttaaatttacgtgtttgtctttatattgatctatctcgtaaaagaaattgtaatttttaatgacttttagacaacatacgaacgtcatctcctcgagtggcagaaaatcacatgctgcttatctggaatggtgactgccatttgtttccaccagtatacgtttttggcacattgaacgttctcttctgatgagtatttcaggttataaatgtttttatctttcaggtgcttcacaaaagaattgcatccttcaaatcattcatgtctgtcaaaggagtttacagagctttgcaatacagagttcttagagctaaccgataaattaaactgtgtcgtataaaaacagcaggattagacgctcttgttctcggtgcgtacgtttccagaactattaaacagtgtgtgttttataaaaattttttatagaaaagttactttaaaagatcatattaatttatttttaaaatctaaaatagtttattctcaattaattatgtgctaatagttcactcattttgcgtatcttttttttttcatctcctctaaaacacaccctaccctaagtaggattacctactagtattagagtacataacaggggatgtggtgttcaccgaagctgtaacggcacgacttgtgcttgacgatgctgagctccccgccacggccgccgcgcgccacctcgacgccggtgagcatggcaaatttcatcatgtcctcctcgccgacgcagcaaggacagctgcaggtccccgggcgcgcgaccatgtacagcttggcgacgcacagcttgccgccgccgaggtgcacgacgttcgtgccgtacggcgcctccggctccggcacctcgaagaccccgcacccgggttgcgccgccggcggcggctgcggctgtgcgacggtggaagcggacaggtcccacgcgccgagcacgccgtcgtccgccgcggagaggccgaaccagaggccgtgctcggggacgtactcggcgcggccgcggaagggcagcgcccagtcgccggccttctccacgcggcgctcgccgtgtcgaacgagtatgcgccgtagctgtgggtggacaccaagacgcgcgcgttgtccggtctccatgacgtagagatcgtcgccgacggcgaacgactgggtccagaacttgtactccaccatggagggcaagacgcggacggcgtgctcggcggggtcgtagaggatggcgccgccgacgatcttgtcgtcgctcctgcgcatgaactccgtcgacccgcagaaggtcacctctgtcggaggcagcgggacgtcctccaccgccgccgacgattagggcacgggcagtgcatcattggggtagaagagatgtgatgggttgatgcggcgtagcctgcgggagatagggccgtgtgatctgtcgaagttgtcgccggatcatcgctgtcctgggctccaagatgccggcggcgattgggcgctgcccttccgcggcagcagctgccgccgcgccgccgcgctcgccgaccgcatctactcctcgttcgcaaatgctaaccccattagcagattgggaacaattcccaataatcgctccggcatcttggaaaaaaagaaagcgaagaagcgatttgggaagacgaagaaccggcgattcctctacatggttgatttccgggctgtagacccctccttccagaggctacgccgaatcgacccatcaagtctcttctacgcagacccggcggcggcggcggcggcggcggccgtggaggacgtccgcctgtctccagccgacatgaacttctttcccccccggtagcgattcggagacggacaacctcacgtggatgaagatcatgcgcaggaacgacgacaagatcatcgccgtcgaccatgctggccgcacgatcgtctacgaccccgccaagcacagcgtcggcgcgttgcccgccatggtcacgcccaagttccggacgctgtcgctcgccgtcggcaaggatctgtacgtcatggcggtgtcacctcgccccgacggcgtcaccgaccgttctttcgaggcgctcgtccgttgcaagaaggaggcagaggacggttgcctctggcgcgccatgccgccgccgccgtacgtgcacgccgccggctacgagaacgccgtcggcgacacctgcgcgtacgcggcggtcggcggctcgcgcatcctgctgtcgtcgaggaggcacggcacctactccttcgacacggcgcgcgccacctggagcaaggacggcgactggacgctgcccttcagcgaccgcgccgagtacgtccccgagcatggcctctgcttcggcttctccgccgcggacgacgacgtcctcggcgcgtgggacctgttctcctcctccaccgtccagcagccggagccgccaccgccggcgcaccccgggtgcagggacttcgccgtgccggggccgtcgcgtcgcagggcgcgcccgtcgcacgccgtcgacctcggcgaatacaccgaggtgtactcgtcgcacgtcgtgcacatcggcgacagcaagctgtgcgtcgccaagctgtacacggtctctcgccgggggacctgcaccgaatactgctgcgatttcgagtcggatgaaaggaatttcgccgtgctcaccggcgtcgaggtggtgcgcggccacgacgacgagcttcgcatcatcacgcataagtcgcaacgttatagttttggtgaacgctacatacccacatctgtactctgacactgcttaggatttgctcaataaacctctgttctgttaatcatgctgtttttgcatgatgcagacttatcggttagctttaaaagctctgcattcgaaagctctgtaaactatttctttcacgatgactaactgtttcactcatttaaatcgggtgttgtttcaccttataaaaaacaatgtttcagcaaatagcaaaagaatgttttagtttactgcaacatttaattcatacatagtaaaacatttttcggtggaacaaaaaataaaacgaattcccttaataggggtttccaaaatatttgtattttttgttggaatggagtatttcagttcactgtaacattatatctactataaagaatgcccgtgcgttgcaacaggtgagtatttttagcgacacatgttttggtgtaatcgagcgaacagagaggaaagatgatgcctgctggatttttcttattttctttcaccctacacaatctagttatcttgtgttacggtaggatggaggactcataaatggacgcagtatcttgagccattcggactgcagctggaggttcacccactgaggagagcgtctctcaacactacaacaataagtggatgtggaccacgtcactagtacagatcctatcatctgtgatgggctcaattatgcctatactacttggaccgtcagaacgaagtcatcttaatcgggcttaaattttcactgttgtagatgtactcactctaggccgcccaagtacatatagcccgtcactgataacactcatctgtgacgggcaaagatttaagcccgattaatatgacctcgcatatctcaattgggcctagacaccgagcccgtcagagatgagagtcatcggtgacgggctataatctaggcctgttagagatgagagtcatccgtgacgggcaataatctaggcccgttagagataagagtcatccgtgacgtgctataatctaggcccgttagagatgagtcatccgtgacgggcttttgtgttggcccgattcagatgtgtcatccgtgacggccggatgctcgattgagatattttctcacatcactgacctttgcttagtgatgggggccctgcccgaaagagatgatgctttaagcccgttagagatgaccaatcccgttctagtgcgtctaatggcatcaaaagtttaatggtgtagagctctataatttcacctaatccttgctccaaattaaattgaccttcaatcgaacgtcaccagctctgatctaacttgaaaaacctcgatctgccgcacccgacctttacgtggcttagtcacccacgatagattcaactaaaactgatacgtcaaaaaaatgaacaaatttattacgtggtaggttaccgctaaggtacgataatggtaattgcatgataaccatattaaaatcaaataaattaaaaaatcatttaaattttttgataaattttatcttcacgatttgctattgttaccgcagtttggatgacaatttggatgatactttttatatttctagttttttactacatatttgcacctactgaaaattgagtctatctcgtgtttgtgattttctgtacaaccagctagctatctcggatgggtgacctatcgggaaggcacacaagtgagatttggatgggtgactgaccgggaaggcacaacaaggctaagcaaaaaaacaaaatttattttttttgtggattatactcatctgtgatgggctataatctaggcccgttagagatgagagtcatccgtgacgggctataatctaggcccgttagagataagagtcatccgtgacgtgctataatctaggcccgttagagatgagagtcatccgtgacgggctataatctaggcccgttagagataagagtcatccgtaacgtgctataatctaggcccgtcagagatgagagtcatccgtgacaggctttgtgttggcccgattgagatgtgtcatccgtgacggccggatgcccgattgagatattttctcacatcactgacctttgcttagtgacgggggccctgcccgaaagagatgatgctttaagcccgttagagatgaccaatctcgttctagcacgtctaatggcatcaaaagtttaatggtgtagagctctataatttcacctaatctttgctccaaattaaattgaccttcaatcgaacgtcaccagctctgatctaacttgaataacctcgatctgccgcacccgacctttacgtggcttagtcacccacgataggttcaactaaaactgatacgtcaaaaaaatgaacaaatttattacgtggtaggttaccgctaaggtacgataatggtaattgcatgataaccatactaaaatcaaataaattaaaatatcatttaaattttttgataaattttatcttcacgatttgctattgttaccgcagtttggatgacaatttggatgatactttttatatttctagttttttactacatatttgcacctactgaaaattgagtctatctcgtgtttgtgattttctgtacaaccagctagctatctcggatgggtgacctatcgggaaggcacacaagtgaggtttggatgggtgactgaccgggaaggcacaacaaggctaagcaaaaaaataaaatttattttttttgtggattatactcatctgtgatgggctataatctaggcccgttagagatgagagtcatccgtgacgggctataatctaggcccgttagagataagagtcatccgtgacgtgctataatctaggcccgttagagatgagagtcatccgtgacgggctataatctaggcccgttagagataagagtcatccgtaacgtgctataatctaggcccgtcagagatgagagtcatccgtgacaggctttgtgttggcccgattgagatgtgtcatccgtgacggccggatgcccgattgagatattttctcacatcactgacctttgcttagtgacgggggccctgcccgaaagagatgatgctttaagcccgttagagatgaccaatcccgttctagtgcgtctaatggcatcaaaagtttaatggtgtagagctctataatttcacctaatctttgctccaaattaaattgaccttcaatcgaacgtcaccagctctgatctaacttgaataacctcgatctgccgcacccgacctttacgtggcttagtcacccacgataggttcaactaaaactgatacgtcaaaaaaatgaacaaatttattacgtggtaggttaccgctaaggtacgataatggtaattgcatgataaccatactaaaatcaaataaattaaaatatcatttaaattttttgataaattttatcttcacgatttgctattgttaccgcagtttggatgacaatttggatgatactttttatatttctagttttttactacatatttgcacctactgaaaattgagtctatctcgtgtttgtgattttctgtacaaccagctagctatctcggatgggtgacctatcgggaaggcacacaagtgaggtttggatgggtgactgaccgggaaggcacagcaaggctaagcaaaaaaataaaatttatttttttgtggattatactcatctgtgacgggctataatctaggcccgttagagatgagagtcatccgtgacgggctataatctaggcccgttagagataaaagtcatccgtgacgtgctataatctaggcccgttagagatgagagtcatccgtgacgggctataatctaggcccgttagagataagagtcatccgtaacgtgctataatctaggcccgtcagagatgagagtcatccgtgacaggctttgtgttggcccgattgagatgtgtcatccgtgacggccggatgcccgattgagatattttctcacatcactgacctttgcttagtgacgggggccctgcccgaaagagatgatgctttaagcccgttagagatgaccaatcccgttctagtgcgtctaatggcatcaaaagtttaatggtgtagagctctataatttcacctaatctttgctccaaattaaattgaccttcaatcgaacgtcaccagctctgatctaacttgaataacctcgatctgccgcacccgacctttacgtggcttagtcacccacgataggttcaactaaaactgatacgtcaaaaaaatgaacaaatttattacgtggtaggttaccgctaaggtacgataatggtaattgcatgataaccatactaaaatcaaataaattaaaatatcatttaaattttttgataaattttatcttcacgatttgctattgttaccgcagtttggatgacaatttggatgatactttttatatttctagttttttactacatatttgcacctactgaaaattgagtctatctcgtgtttgtgattttctgtacaaccagctagctatctcggatgggtgacctatcgggaaggcacacaagtgaggtttggatgggtgactgaccgggaaggcacagcaaggctaagcaaaaaaataaaatttatttttttgtggattatactcatctgtgacgggctataatctaggcccgttagagatgagagtcatccgtgacgggctataatctaggcccgttagagataaaagtcatccgtgacgtgctataatctaggcccgttagagatgagagtcatccgtgacgggctataatctaggcccgttagagataagagtcatccgtaacgtgctataatctaggcccgtcagagatgagagtcatccgtgacaggctttgtgttggcccgattgagatgtgtcatccgtgacggccggatgcccgattgagatattttctcacatcactgacctttgcttagtgacgggggccctgcccgaaagagatgatgctttaagcccgttagagatgaccaatcccgttctagtgcgtctaatggcatcaaaagtttaatggtgtagagctctataatttcacctaatctttgctccaaattaaattgaccttcaatcgaacgtcaccagctctgatctaacttgaataacctcgatctgccgcacccgacctttacgtggcttagtcacccacgataggttcaactaaaactgatacgtcaaaaaaatgaacaaatttattacgtggtaggttaccgctaaggtacgataatggtaattgcatgataaccatactaaaatcaaataaattaaaatatcatttaaattttttgataaattttatcttcacgatttgctattgttaccgcagtttggatgacaatttggatgatactttttatatttctagttttttactacatatttgcacctactgaaaattgagtctatctcgtgtttgtgattttctgtacaaccagctagctatctcggatgggtgacctatcgggaaggcacacaagtgaggtttggatgggtgactgaccgggaaggcacagcaaggctaagcaaaaaaataaaatttatttttttgtggattatactcatctgtgacgggctataatctaggcccgttagagatgagagtcatccgtgacgggctataatctaggcccgttagagataaaagtcatccgtgacgtgctataatctaggcccgttagagatgagagtcatccgtgacgggctataatctaggcccgttagagataagagtcatccgtaacgtgctataatctaggcccgtcagagatgagagtcatccgtgacaggctttgtgttggcccgattgagatgtgtcatccgtgacggccggatgcccgattgagatattttctcacatcactgacctttgcttagtgacgggggccctgtccgtaagagatgatgctttaagcccgttagagatgaccaatcccgttctagtgcgtctaatggcatcaaaagtttaatggtgtagagctctataatttcacctaatctttgctccaaattaaattgaccttcaatcgaacgtcaccagctctgatctaacttaaataacctcgatctgccgcacccgacctttacgtggcttagtcacccacgataggttcaactaaaactgatacgtaaaaaaaatgaacaaatttattacgtggtaggttaccgctaaggtacgataatggtaattgcatgataaccatattaaaatcaaataaattaaaatatcatttaaattttttgataaattttatcttcacgatttgctattgttaccgcagtttggatgacaatttggatgatactttttatatttctagttttttactacatatttgcacctactgaaaattgagtctatctcgtgtttgtgattttctgtacaaccagctagctatctcggatgggtgacctaccgggaaggcacacaggatgggtgacctatcgggaaggcacaaaagtgaggtttggatgggtgactgaccgggaaggcacaacaaggctaagcaaaaaaacaaaattttttttttttgtggattatactcatctgtgacgggctataatctaggcccgttagagatgagagttatccgtgacgggctatattctaggcccgttagagatgagagtcatccgtgacgggcttttgtgttggcccgattgagatgtgtcatccgtgacggccggatgctcgattgagatattttctcacatcactgacctttgcttagtgacgggggccctgcccaaaagagatgatgctttaagcccgttagagatgaccaatcccgttctagtgcgtctaatggcatcaaaagtttaatggtgtagagtgtagagctctataatttcatctgatacttgctccaaattaaattgaccttcaattgaacgtcaccagctctgatctaacttgaataacctcgatctgccgcacccgacctttacgtggcttagtcacccacgataggttcaactaaaactgatacatcaaaaaaatgaacaaatttattacatggtaggttaccgctaacgctaaggtacgataatggtaattgcatgataaccatattaaaatcaaataaattaaaaaatcatttaaatttttttgataaattttatcttcacgatttgctattgttaccgcagtttggatgacaatttggatgatactttttatatttctagttttttactacatatttgcacctactgaaaattgagtctatctcgtgtttgtgattttctgtacaaccagctatcgtgctggatggccttcttcccttctctacgcaacgatgcctgagatcttgctagccaatcaggggcggatctacagtatgaggaccggtgtcaggcgacaccgacgacattcggcaaaacctataacaaaactgcttatctatatattataacaccataatctaagtataattagtatactatgacaccgatagatccgttatgacaccaacgaatcgatttttgatccgccactgtagccaatcatttttgctccatgaaaataggagtccagctttgatttgcatgcatgcaaaatctatccacgtgcaaagatagttatcggtccatcttgatccggactgaccggcccttgctgcgcacagagaacacgtctcgtgcgaaacggaatacgatggatcatacatgcgacctaattcctccgtttcgcaatgtaagtcattctagtatttctcatatttatattaatggtaatgaatctagatagatatatatgtctagattcattaacattaatataaatatgggaaatactagaatgacttacattgtgaaatggagggagtaccaaatatcacggtaaaaacatcttaaattttttaaatatcgtgtttgataattagcatattgacactgttaggcgctagctacatgacgatgtcgatactcgatagagatttggccggctgccaatggaaacggagacggatacagagcaggtcgatcgcatatgtatacgtggatttatgttttttttttgctgggtgagatttcttttttatccatgatccatcaacgccacacgctttggaggaaataaaaaaaatcccgtgcgaagcgagacgggcaggctaggtcgatcgcggccggaagaagcatgtgcgaaacggactcggactacacgtgaagcgcggcgtttggcgcgtgcatgccaacgcggagcggggcgtggctcatgagcgaagcagaatcggataacatgacgtacaaaatagttttgacaaaaacaccttcaacttttataataatagagatatatagtgaaacattatgaatacattaggtgaaacatttttggtggaacatgtcgacgagtgatactcgcggaccggatgaataaagtattagggtacgttggaacaggggtctacgtagtatgacattaaagcagacaaaagacaaggattatactggttcaggccccttatcaggtaatagccctagtccagtttacatgggattgatgatgatgagaacatattacaaagagagtaaccgaaacaggcgataccgacgagatcgtagtcaagggattcgacgagatctcccggcgagttggctccgtgtactccgacttcgtaaactttggtgggtgtgttggcgatgagattcaatgatccttaccgccctcaggggtccccttttataacgtagattatcttgacccccaagcaaagcttgaggatatgtaatctggcacgatatagtagagattctatcccctccgagtaggactccggtagtttcttaactcatagagatattttccatagtttgagataaattcctaacagcatatacggaaacgatccgtgcacgtgaaggttatcggtatattccataagtcgtagtatagagggtatgccttatccgtaacctaccctgacagaacaaaaaataaaacgaattctcttaattaataggaggtttccaaaatatgtggatttttttgttgtaatggcaggtgggagcagagaatacggtagggcctagagcctgcatacacgcatgtagagggaggggcgcacgggggagtgtccgatccggctccgccgcgtcggtcgcccgggagaatcaagagcaagctatgttatttggacggtgaagcaactacgtgcatgcatgcatgcatagtaatgcacaaacatatatggtgctcgattatgagtgaggtgattagcggaagagagataaaatcagatgaataaaaagataaacaacaaaccaattgattttatctgtagcaacttgatcgagttggttgcttggcgcgagcgctagcgatgcgcttgtcaccggactatggcccagcagcagagaaacaaaacgaactaacaaatcaaatcaagtttatctccatcgattgcttctgcgcggcaccgacctcctagactttattttccaccctaaacaaggacgtcgtcggtgagcgagaagacgcgcgtgcgcttcggcggcgccgcctaggtttgccatggctgcagattgatcgtgttttttcattcagaacggaagcaggagggaggaagagagggatggctggggttaccttttgtcgagctgagggagcgccggcgcctccggtgtcgtcgccgtcgctgccgcgccggagaaggggggttggatttggaggaaaaggaaaaggcggcgatgggagggagtcggaacgaatcgaggctgtcgccgtgctcccctcctcccgcgtcgtcgtgtttcctagctgcagctgtcgccgccgggagccagccgatgttgcgccgccggccaccgtcgcggcgccgccgccctcctctctcccgcctcgcctgccggcctcccgccgctttgccttgcttagaaagagagaagaggagaaagagggtgatggcgtggattacgctgacatgtggggtccatgtggatcccatgttctctccttccaggtgctttcctccggctacaggtgactctcgtcattcttcttttcttctggctggcagccgctggcagctgccgtttgcactggggatgcgggaacccggccggagtacggggcccggaggggcccaggggcgtggactaatttcaacccgttcttccctccggggccgggtgaacccgctagcgtgcgggggcggggacgtttctatccaacccaacctcgccctgtcttgttgtcatccatgttcccgtcgccacccactggctggccaagagatagatagaggaagagaggtagaggggctatgacaaaatcacttaggattggatcaagggggtattttgtactttttcgagttcagggggttattcgatcgactacgatagtttcatggggtaattcgtaccttttcctttttaaaatccattatgcgtttatcaaatttaatttgtatgatctaaagtttgcatgatctatcaaatccgtgcaatcaatcgatcattaaactttggattataagattaacaatgtcgagctgtgcatttaatcaagtggatggatatgtggtgtttatctaaaaggtaggagtttgcatgaaaccaaaggaacaaatggctcgtaccgaacaaagcatgcccacgaaaattgtaaaagatatttctctagtaaaccagtccattacttctctactattataaatactgaagatgcttcgtcgaaattttggtacgtcatcgtatttgagttggttttgagttgtttatatgccgttcgcatccaattcaatttgagtctagaataactattatacgctcatatcctagcgcaacccctcctctcagcccaacccaaccgatccacaccatcccacaagcctccactcgcccctctttcgttctctttttcttctttcttttctctcgataattctgatactctccctctcctaccaatctccttttcttttctcctccttttctctctattcttttttttctcccttcacaaataatttttatgcaacaattttgttacattgcaaatgctttccatctacagtaaaaaaagcttttgctaattgaataatgaaaattttaatttttgatctataagatatagcaaaatgcaccgccgttaacttatgaaagtcacccaattaatttgtgaggctatagaaacgtgtatacaagggatatttttgtatgatacgtataaagtgggcgtaacctggttcattgctatatatgattttttgactttgtgtttgcaattgttttgttttgttttgttttattttagtttgttgtttaaattaacaaagtgtttatcaatcctgttgcaatgcatagatattttttttactaactatatataaacttgtaaggaaaattttagtaaataagtcaccgcttagacactaactatatataaacttgtaaggaaaatttaagtagtaaataagtcaccgccgacgggccaacaccacggcggcgaggatgctcgccaacttcgccgccctccccatttcaccgacggcggcgctgagatggaagaagtttggggtggtgatgtttattaaatatttttgatatgtttttttcttttgaattgatatgagattgtgtgagaaagggggtggaattattgggatggaattgatttcctcaaattctaaggcatcttaagatgatgatcatgtagtttgtttaaaatatctctaatagcatactggaaccaacattccaaaattgatctgtcatattgtcatacaaaacatcatgggcattcatgggcttgctacacatcaccgctaagaaatggtccgtcatattgtcatacaaagcatcagggcattcatgggcttgctaaacatcaccactaggaaatggtgaacaaactccacaatatcataaaacgtgtccagccaatcaccaagcaagcatctgtttatattttctatttgtagaacaaagagaagtcgaagtggtcgcaggcacaacagcgggcggcgaagtagcaggtggcaaggtggcttagctacacagggtggcacgggcgaaaccctagccgccgccgcccctcctcctccatcctccgtgcctcgccgctgccggagctcgtcgccggcaaagccgggtgacgcgctgggatggcggcggcggggccattctcctcggctccatctcgcccggtgagggcgtggcgacgatggcggcgggacgacgaggtcgcggcgacggggatggcgcggcgacggcgctgcggtagggctcttcacggcgacggcggcggggctctccgcggcggtcggctccggctctggctccagcgacgggtgacggagttgccagatccggttgcccctctccggggtggccggatctggccggaggcggcggcggctagcggcgagcaaggccacggcggcggaggcggtgggggtcgacgcgcggggagacgcggctggaggccggcgtgtgtgctggccgcggacggtgaggaggctgcggaggccggcgcacgaggaggccgcagtgccgcagcgaaggctcggccgaggagcgttctccggtgccggctgccgcacacctggcaggggggtggctggcggtggcgatggtggtggatgtggctgcgacgaagttcgcgacgacggcggcggactgcggcgcgtgccgcgacgccggtgaccgtgtcaagaacctcgccgccacgagggaggcgtggcgccctcgttaatgctccggccatgaacgccgtgcccgtgaaacctgttccattccaagtgaaagaccagcagctgcgcgccttaccttctagtaaagggcgaatgtttccgggctcgcctcttcgaggggcctccgctcgtggacaacctcgaaaagtcttaatcatcctggtgctatatgaaaaaggccgtgcgtgctagaactctccgtttctggcatgctatagttcttttagtctctcgacgacgggaatgggagatgaccggtaagccagatgcttcgcgaaccaccggctcttcgatctctatctctgcgttgcactccgagtaaagatatacctccattccttttcagaagggttcttccctgtgctataatgctgaactaaggacgttccgccttatctatagaagcttactgggatgatacccctggagggggggatcattcaagtaaggtttctggctctttctttgtcgtaaggtctagagttggacaaccatcatagcactcgcccgctatattcaccctagcccacaagcacaaatcttcggcgggtctctttatatgtcttgtccagaaagaggaggagcacatacatttctttaaaaaaaggtaaagcgttccctcgctacaaagaaacccttcatctagttgacttgaaccccattcaactcaactcgatttcaggttttgctggaggtactaaccacttagtgatcggtccgctagtgcttccttataaaataatatatagctagctgtagtagaaatggggtagtgcattgaccttactcagtttattagtgccatgtgaatcgctagaaacatgtgaagtgtatggctaacccaataacgaaagtttcgtaaggggactggagcagaggaaaggtatagtctcgttaacagataaggaaaagtggatcccgtactgacatagtatagtctattgatacagtatccacccaggctcaaatcaaacgacagtgaggaaggtgagttggatgcctcatgtcaaatgagactttctcctcaccaaattgaagcgtgagcttcctccatgacgccggtgacccgcgctgcgcgctgcacctccagatccgtgccaccccggctgaatctggatgactggcgcctggcggcgctggctggcgacggtggcggctggacggtggtggctgacggtggcggctggcgacggtggtggctgtggcgatggcggtggcggctggtgacagtggtggctgtggcgatggcgggttggcaaggccattacccggggctgacggtgcgtcgtcgacggcggcggcatgtggaggtggggaaggagtctggcggcggggaaggaggagtccgggtgcgggcgcgccgtcgacggcgggaagaactatgggcggtggccttggccgattcgctgaagggacaatgttgttgacatccttcttgcgcggattggtggtgtgggtttgggcagggaatcgcgggcgaaagccttgccgagccgtttggccggctgatgacggcaacgccgtttggtgtcgttcccctccttagaggcgtcgttttagcaaacccctctcttttccctaccatattctccgggtgaaaaccttgttcggttctgaacgagcggtggcacgtcgtgtcctccttgggggcaccactttggagaaacctgttcgtgcaaggattttgttaatggtctatgcattggcttcgaacttcagtcctaggttttgacgaggccttctagctacacattttgttttgcttttcttagtatgggtcctctcttttccggttcggtgtgtttcggttcggtgtgttcaacttgtcttgaactacactctcttttggagtggaactttgtaataattggttgtagctctttttgagcaaaggccgggatatcatattccattatctaaaaaaaatgagtcccagttgaagtggcatgagtcctgtcatcctatcctagattgagttatcttgggacggagggagtactctacttgttatagtagagaaatggggatgcagtgtgtgtttaccgaagctataacagtacggagcgcgccacctcatgccagtgagcatgacgaatttcctctcatcccatacgaagtcgtagcaagattggcttcacactatataaaaacatttgcaatgaaaacattttcgggcgttgtttcataatatataaaaataatgtttcagcaaatagtgaaaggatgtttcaattaactataacatttgatccatacataatgaaacatcacgagtacacttgctgaaacattgttgatggaataaaaaatgaaacggatttccttactagagcgtttccgtgatatgcgggtgatttgttgtaatagtatggggggacagtgcgggagcgcgcgggtggaggcgggcgcccgatttttctaccgctgattgggcgcccgatcactggtgttttcgctaaacatctaccacgtaagagaaaattgggctctgtactaccataagacctataagttcacggttttgtatagtgtagagccttgtatttgggattagggatgtaatcaaactcgacgtaaagtaaagggatgcagagtagacttattcttactacatggccatacagcccaatgaccaccgcagcccacaaatgatgccctcaaaaaccgaatttttttcggttttagattttttttaaaaaaatatttacagaaataatctatcggccaaaaaaattacaaaaatagaccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctgactgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgattgtaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccattgcattggcttacacaagaagatattacgttgtagatgtttattgcatgaaagagtaatatgatctagttatttcgttgacagatatgtcgaacaaacaaatattccgtccgttacgggccaactggggtagatctgtcagattttattgtatcagaaaggggaattgatagaccagctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttgaaaaatgcattgcaacgcgggtggcctctagctttggttccgtttgttcacccgaaggatccaggtgtgcagatgaacatggatgatggcgagggaccaagtgctgaagtaaacgagacttctgtggaggaggtcaacgcatgagaggacgggggcgtagtagctccaatgggcattcaacaaggtggagtggccgacgagggggagactgtcggtgccattgtggatgaaatggagagggaggattctgacaacgagcgtgtagaggaaggtgattcgtcagatgatgagatggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacattgtcagtcgttaccaagcatacatgttttttacctggtgttcagaaataccacaggaacattacttgtgcatttgttgcatctgagatgtatgcgcatgtcatcgataatctcacatatgaaccaaggtcaataatccgacacatcgaagagatatacaagtatactattagctatgccaaggcctggagggccaaacagaaaataatagagatgagatttggaacttacgaagcctcatatgacaatttgccacgcctgcttggtgttatcgaggaaagaaaccctgggagctcttacgaattgaagaaattcccctcaattgaacatcctagcaagagtgtgctgcaaagggccttcttagctctacatgcatgcaagatggcattcgtgaactgtcgtcctgttctctgcattgatgggacattcttgacaggaaagtatcggggccagataccaacagcaataggggtagatgggaacaatcaggtattgctcttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaagagagaaaattcaatgagctttggaagagattagatgagttgacagccaaatgcagtgttcagtgtgcagcggctccatcgaccgccgttgctgacccccctcaagctcttggatctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggagctttcatgcagaaaaagctagaggagttgcgtaaaaaggccatgaaacatcgagctgtagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcagccatgtcattgctgccgcagcggagtgtggcataccagatacagtatatgtgtcacagtacttcagtaagcaagcaatatatcatacatggagcggcgagatttatgggttcggcatagctggggagttcacagagactaacgatgaagtactcaatattcctgacccatcgaagctccgaggcagggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacatgtagacccccgtttttataacaggaatcaatcgtgtaaacaataccatttccctggatcaagtagtctggtacacacgaattcatagctgaaataccaagtgcacatacacgagtgtctaatacgaattattacatcataagcccgcaggcgtagtcttaaatcatcggaccgggcggtccggaatacatccaaaagcagaaatagataaggcagcggaattcaggcagcggcatgccattgccacaggcaacgaccgtactaagacctactgagcaccatcgtcttcatctccctcctggtagtaggcatagggatcctccgaggcttcatctcccgcttctgattaattttatatttgcaagggtgagtaccaaccgtactcagcaagccaccacagcaatgatgcacatgacagaggaattcaaaggatggctatggttcttttgcgcaaagtaaattttgtaattcttttcacaagcctaagacctagcatggactgatcaagttttaataccagtgttcatattaaacaatgacggttctgtccaccatccattgtgatcccaaggatagcttcccgccattgagtcgttatggttttctgaggacgtccatattcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagtggagttctggcgctcccgggaaagagaagtctcacacgcatattaaattatggttcaagttaagttccctctctcacacactcatggcagtcctaccaatggcgacaccgatgtagggcacgcctctcggccctacctcaacagctgtcccaccgtagcgcacctgcctcactcaggggtgaaccatctatgcagggatactgcctctgctcggctatctaatccgctagttctatacccatacgagaagtgcggatgtacgggggtcgtttcatgcttaacttcatggctcggtccttaattgaccggggacggtactagccttttccagataccacccaaatcctccgtccgccccagtcgaaaacagttgtttaattttatttttcctttcacaaatcatgtcatcaacatcatggcaatgtggcgctcatgtctccacatgccgcatctcaattaccttcccaaaggtaattgcccaagcatatagcatttgataaatatgattatgcataattctagaatagcatttctaagcaattgtcatagttgactagggactcatacgtaaacatggttacaaagatttaagggtaaacaataatcaaggcatggcataatcacaagtgggatgttcatcattgcatgcaattttatttgtaaacaaaacaatttcgcaattgggatcaacatgttcaaggaatagtgatgacttgccttgctcaaagtcttgcgggtcttggccttcgcttggatccgcaactccctcgggctctatagttacgtgcgaaaattgatttgaattcggttagaattcaaataagaatccgaataaatccaaatgacagtcgaatgcgaaagtcgtttcctttttattaacttcactatccgcgaactacggcaaacccaatttcgatttaaactattttgcgggtataaatattttgttgtcataagttttcaatttaatctacccgagcattatatccatataataggttagaaatttctatcgcgagctaaatgtcggacggaatcctaaaattatcttataatattatacgttttaatttagtctatgactaaacgattaaatataatatacgtctaaaattcctagcgattaagtccgaatttctaccgtgaatcgattacttatagagattatccaaaaatgatctatagtagtctataaagattcatctaattgttaattatatctaaattactactgcgaattgatttcttttagaaattaccaagaataattaaattttgcaattctgggaccatgattattctataattaaattttaattattttaaattttctaaactattaaccttcctaattttcttccaaatttttctatttatttttccttttcctttttccccctttcctttttcttttctttttctctttttctctcttttccttttcttttctttcctctctttctttttctctcttcctctcggctctatctctctctctcggctctatctctctctctcggctctccctcctacccgagcggtggcggcggtggacgcggggggggggggggggagaaggagggcggctcaccgacggcggcaacggcgacgacggcggtggcgacggtgccgtacggcggcacagaagcggtggtacggcggcgcgggaacggcggcgcggcggcacgggaacggcggcgcagcggcacgggaacggcggcgcggcagcacgggaacggcggcgcagtggagaggggagaggggaggaagggtgagatggggtgggggagaatggagagagggggggtatttgtagagaagggaggagcggcggggctcggggcggcgcgcggggctcggcgcggctcggtgtgacagcgatggcgacgcgacgatgacgcggcgtggcagcggcgcggggcgcgaggcagcgacgcgatgggcgagcggcgcgcggggcgcggggcgcgagacggcgcgcggggcgcgaggcgacgggacggggtggcagcggcgacacgatgggcgggcggcgcggcgcgggacggcgacgcgcggtgacggcgatgcgacggatggcgcggcaacgggacgggcgcgcggcggcaggcgggcgcgcggcgcggcgacagcgtggcagcagcggcgcggggctcgaggcggcggcgcggggctcgaggcgatgacgcaactgtgacggcgatggcacgcagcgcgtggtgacggcgacgcggcgcggcagcggcgatggcgcggcggcacggggcggctaggggcagaggtgggagaggagggggaaggctagggaccacatcgaacaccttaggtgcaatgaacagtgacttttcctatttatcccgattttagtgtaatttccatataaatttgattccacaattcctaattttacatatatgcattttactcaatattcgtgttatcttaactaatgaattcaccctagattaatattactcacattttatttttatataatttatttgagttttaattagggttaattcttattccatcgcgattaaatttaattgattcaaatatggtcgcgataatattttatttaatactatccacacctaatctttatttttaatttatatttattttaccaatttgtttttaaggtttattcctgattaactgttctttactcacgattaataatcttcgagatcaaatccaggtaaaataggcgaataagatcggcatgatgcaattagtttgaaaagtttttgaaaatccgtatttttagagttttgattttgtcggtcgaattttttttttagggtgttacaaaacactatatttttcagagatggcacgtcaggatacacctcagttgttggacccggcgatagatcaccgacaccggtctcaccttactgcggtgcagggggctcagcttgggacgttctgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcgaacccggctagacgatggactgtggacaggtccctcctagcagctttggtcgatcgatggaggccaaagacgcacacttttcacttgccgtgcagtgaggtagcccctaccctacaggacgtatcgtacttgttggggctaccgctcgcgggagacgctgttgggccagtgaccacggctgtggactggcaggatgatctgacggcacgtttcgcactagtacaacgcgcaccgcacttcccgctcaagctgttggcacaccaccgcaacactggacctacgaagaggtggttgcttcagttcaccgtgagtgtttttgtaccgaaatgacaatcgtattacatctttagtccgcagttaaggtgcctaacattttatcgactgcttgcaggttgagcagctacaggcggaggccgacgagtactcctacagccgatgtttggaggcgtacttgctctggctttttggctgggtgatgttctgtggccgtcacgggcacgcggtcgacaagggactcgtgcactacgccaggagcatcgccgacgccgcggtaggcgaggtgcctcagtggagctggggttccgcgttgttggcggctctgtaccatgcactttgtgagtcttgcacgaagacggatcccagcgcgacctttggtgggtgccctctctttctttctatctaggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcatctcgtattgcagcgccgatgggctcacgtccagattaggcggtcgtatcctgagtttgttatggagttcgaccgccttctgccgactgacgtcgtgtgggagccctacagtgccgcggctacccaggctcgtgcgccattgggtctgtccacactctgcaccagggaccaggcgtactggatgactacggttccgatggtcttcgacatctgcgttgagcctcacgcccctttccgcgtgatgcggcagttcggcttccgtcagccctttccagtaccgtttccgaccaccgtcccagctgctgttcaccggtaagatcttgcactacgctttccattgttgcaataatttgtaacatctgtcgtttcacactaatattacacattaattcgtaggtactcgcgcaagggtcagcagtcagctggcgactggcccgccaagttggcgacttttgttgaggactagttactcgcaaccgaggaggtcgtggaccacgagggagagccacacactgaggagtcgtaccaggcctacctacgctggtaccagccacacacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctttctcttcgtcaaattttacgaatatttacgaacaaattaaccatgcaggttgacgacatcaaccgggtcgtcgttgacggttcaacgacgatccaacgtttaggcgcggggattccagtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggtcttctgttgtgccccccacaggtacttaaaaaaacaacattacttccacaatcaatttacatacattttatgtcttagcttacaagggtcccgttgtcgatgtgtaggtttcacccagttcgctatgacgcaggccgcccacttctcccaggctgcagggtgagcgtcacaggcagccggcacgtcgagtcagggtccaccactggaccatgcttggacctcgtcggaccgcttgctgccttccaccgtgctcttcgacatcactgacttcgacttcgcttcaggctcgacagaggacgtcattggcccctcacagctgggaggcgcaccgcaggtgcagacgcaggaccaggcacaggccactcctccgcgggacactcgtgctacccgtgctgtgccaccggatcgtttcacctactcccaggaccacgtgcgagcacaggcccggaggaccaagcgtggtcgcggcgcggggcagggccagtagagtagtcttctctttgtttacttgcttcactttccagtactgtatgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttcttgacctaaccacttgtttacaagaaggtcgctggtatttcgcatcggaaagtaatgagaaatacttatagagaaaagcggcttatgaacgacaatgttgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttaattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgtttaagtccatataatgtttctatgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgggtcccttgccgccccaaagtacggccgcaagctctttatgggcggccaaaattgcaattagcccctgtatgggcggcaagggcctaatcgcaattttggccgacggcggcagacggcgcggtcgacccaccgtctgccacgtcagcttgccgcccaccattatggcagcaggggctatttctgcaattttttttgtcgatagattatttctgtaaatattaaaaaaaaatctaaaaacgaaaaaaattcctcaaaaacctaggcagccacccgtccgcaccgcagattgagatcccatcgccggtcttttgcttcccccgccgccgccgccgccgcattagcaaattagggacgacgatgatccgtcgcttcctctacatggtcgacatcttcgacaaagccggctacggccctcaaccctacaggctacgccgcatcaacccatcacatctcttcttccccaaggatgcgctgcccgtgccccagtcgtcgtcggcggcgacggtggtggaggacctccccctgcctccgacggagatcaccttctgcgggtcgacggagttcatgcgcaggagcgacgacaagatcgtcggcgtcgaccggactactcgccgcgccatcctctacgaccccgccgagcactccgtccgcgtcttgccctccatgctagcgcccaaattcaacaccaaggcgctcgccatcggcgacgatctctacctcatggatatgacaccttggcctgacaagggtgacgaccgtcagggtcgacggtcggggcattctttcgaggcgctcatccaccgtgaccgacgccccctcaatgggggcaggctggaggacgagtgctactggcggcccctgccgccgcctccgtgcgtgcacgccgccggctacagaggcagcagcggagagatccgtgggtacgcggtggtcggcgacgcccacatcttggtctccacccagagctatggcacctactccttcgccacggccaacaccgcgtggagcaaagctggcgactgggcgctgcccttctgcggccgcgccgagtacgtccccgagcacggcctctggttcggtctctccgccgccaacgatgacgtctttggtgcctgggacctgtcctccaccgtccagcagcagccagtggtggcgcaccgcgggtgcaagggctttgcagtgctagagacgccatacgcctcatacgtcgtgcacctcggcgacggcaaattgtgcatcgctaagctgttcatggtcgcgcgccgcgagacctgcagcgaatcttggtgcgactttgacagggatagaaggttttgcaccatgctcaccggtgtggaggtggtgcgctgcaacggcgacaagcttcacatcatcaagcacaggtcgtgccgttatagctttggtgaacactacatccccacttatgtactctaactagtagagtactcctgcttattagttactccctccgtctattatattttgggatggagggattagtcttttaataaatcttaatttggttaatcctgctgtattttgggatggagggagtagtgttttagtaaatcttgattttgttattcctgctgtttctgcaaagctctgtaattgacatgcatgatttgaaggatgcgattttagtgtctctatgattttgattcttttatcatgctgcataagcgcatatagcattggatcatctcaggcaatgtgaaaaacttatttcttcaatcatcattgggtaaatgtgcaatttttgtgaaaaacccatattgctgcatgtaaaagtatgcaatttttaactgttaacaaacatatactcttaacaaaatataagagtgaattaaaatgaaaatatatagtcttaacaaatccttctgtgctctctgttgattataccagtccaaaaacatttagtcaccattttccatgcgattaacttcaagaatgtctataaatttctctggatcaaatccttgatccagttatcttttctttggtccatgtgttttaactgcaagaaaggtcatactagataagtttggcaaacacaatggattttgataacaaactctttgaaggtggggattcttcagcttcattgcaacttgcaggtttaactgcacatcctacttcatcctactttaatatttttcaatgagtaattgagtatattacatgccttcgatcagtgcccctgcatactgtcccagttatatcaacgttcaatccaagtttctgaacagtattgcctgatatagcctcctgtgagtctataatgattccttctccttctgcctgagtctgttggctttcaagtaacacaacattgtcaggaataatgctgcacttttataataattgtgcatattaatttgacgcctcagttcatctttcatctgatccgtgtcagcaatggtattgtgactacatatatgtacttttacaagtggatttttatgatgccagactgggatacagacatcattgtgtaactgaaactattgtatctaaggcatagcacaaaaagttccgatagtcatttataaagttccgatagtgtgatgtcttgatcttgctagtcattgcacggtgcttcttttcgaccataaagtctttatttaatctgatgttcctggttcctgattggtggttggtttacataggtttggtaggtctcactgcagaatgcaatagtagttgatgcaagcaggtagtacacccccttcatatcatttgaagttgataacttttcttgtatctgacaactgaactactcaaactttatctacacatttctgattctgtcaaataacaaacactagaatggtcttcttgtccttgtatattagtatcgtattagtgggcatcatttcactaacagttaaatctgtagttactatgctggaaaatggttgggacaagtgatggttatcatccgctatttctcttaagtcttaatacaaagatacccaagtgatcgttgttgatgctagcagcacacctcctttcatatcattggaagttgataacttgtcatgtatctaataactgaactacttaaacattgttatttctaattttgtcaacgaattcctgtttctgtaaaacaacagacacaagaagggtcttgtccttgtgtattgtcatattagtggcgttgttctagtaacagttaaataagtggttactatggtgggaaatgattatgtgaagtataagctgcatctgttacagcaactgattaagtgaattagccagtgtccatttttcagcctactagtcactatctttgtgaatatggaggtgaaaatgccatgtatatgcattcactgccaagcttaatagtataccagatcatggaatgtgcagacatatgccgcctgatcactactgttatgtatactagtacattagtatctgttttggtctgctcagatgctttattttcagttgccagtgctcacctcactgtcagaatgaggggagcaaaggtttattcagttatgctgcatttgatggaacgatctttggtcttcttttcgccacaggtgcagactgttctgctttgtttaagttgcagtcctacatcagtcctacatcagacattgttttagttcaaatgcatacattcatggaagattagcagtttgttgtcctgccttgcacctgatacccaaattactctggtgaaacctatcctgtttacttccagggtagccaaaacgaaagggttagttgcagtagctgttgttttttggtgatgcactaccaaagtcttcttacatcacattctgctgcagtcttacactttccaaaactagtaatcgtgcactttgcacgttttccatatatggtaaatagcaagaaacatgtgaataccctgatagtttattgtgttttccccaataaatgtcgcatgaaacatacaaatacacaagtttaagaacaatatgttctaacatgatctagcctattttggttaccccctcttggacacttgttgtggaggtgcaaagtagccaacattacaaaatggatacaattttccacaacttaacaaacacttgaaaggctcaaagcaaaagagttgtcttcagatgcattcaagagaactccactaagtaagagaaaataacacaagtatctacacaattgattcgtgtcatccacaataacttcaaatgtaaccctcacaatctgcaatccacaatatcttcaagttgacatggatattttgagctgcattaaaaaaaacaaaattaaccaaagaatatcactacttggagaaaaaactgaaaactaaaccaggaacattgaaatactctcaaactgaataagtatttgtataatttttggaaaagagtatcacatgtgttgttagacatacattcttgaatgagcataaccgatttttcccaaaaaataactaagaatcattagtattttgaaactactttgaacataataaattcaaatagtaagcacaactaaacaaattgtaagccttcaggcttcaggcagctatgcaccaaactccagaaatttttttcagtctaaataaagttgtaatagtgaaataagttatatggtagagcaaaatgttagggtatcaaccaaaatggttcagtttgagtccagcagaaagcgagtttcatgccctcattgtaaaatcaaatacaaatgttatacttccaatacctgaaggacaattttttcctaaggacggtaaacagcctcaacttatgcaagataaggtggcaggcatatacgattttacaatttttatttttaaactttgaagaaagatatgtataacttaaaccaagtcataaaacttgattctttaactaaaatataagtgttaattttaaagggctacagttcaagaatgtccaaatcagataacataatgcaatgtgctatatatcctaagtgtgaggtaataaaaataaatcagataaaaccatggaaacttttgtttgctgagaaaaccaacaattcaaaatagcatccttaagcattcatatcatcaatgatcctgtaaaatgtgaggcacatgatcttctagtagcagattagaatagaaaagactgttgcactgaagaaaatgttgatacctggcctcacacatgatgtaagactgcttctttgttaaaaaaattgcaaatgttattttgcacgtggtaaaaaaggttctagcagttctttatagggataaaaaaaaaagaaaaaaaactacatttggcagtttttaataaatattttgcactgaaggaaatcatgaagttctacataatttagatcaattaagtagaccaaatacaaattcttcgtgttcttcatgaaccacagtgcagtatacatgacaaaaccaataaacatttgaactaaaattgacacagctacagtcaacaggtatactaagcccctctctcaccttttccttttgttttccttattgcaacctttgcttaggatctgtctagaccagatcaagagagcaacctagattaatttaacagaaaaacatcccacaactgatgtaacagaaagaataggcaagcagataatccatcattgataaatgtctgaaatcaccatgttcaacctgcaaaagaaattttgtcaacaagaatcggagatttctgaaattaattaccacactggccatcaaagccaagtagagattgctaaataaaccagccaccgccaagttgtgtttctgcttctgcaaagtatatatgccaagtaacgcttctgcttctgcaaagtagaggattccttcacaagtgattggtcagctttagggcctgtttcgtacagctccaactcctaaatttagcttcaagagttgggtctggcgtggagttgtggagcttcctaaacaacgctccacaactctagtttattttgtgagagagctccacccatctccactcccagttttggtggagctgaaactgtttggctgagctctggagctgtagctgtgccaaacaggccctaagggtcattccaaaagactggaatggtgtgtttgagaaagaaaacaaaggactgcaacggttacattttgcctaaattttcagattaaactgcaggttcattaatagagaaatcgttattgtaatttacatatagctgttgcaatctacagtctaaagtgagggttcacctgggtgggggcagatcctccaccacagccatgtcgcacaccccagctgtgttcaaagagaggaagcgatccgcgcagcctcgagccctctacggagtagggctttgactccacgctgctcctgccataatatccccaatgttccggcttgagaaaatggagacagtgagttgcagatcgagattatgtgtcatcacaatcatgcgagcaacagggtgcaggtgcagttgctggtggcctgtggttgatttccgacggtgtcaggagcagagaacggggaggggccagtaggtggagcagatgctggatcggcttggcctctctggcaggggcgacctcgacggaggaaccaatcggatcaacttggactcggcaacaggcgtgagaaaccggcgacgcgatggggtgcgatcggcggggcagaggttgcagcggcggagaaatcgcgatggagcagcggatgggcggagaaatcgcggtggagtgcacggcggcggcggcagatggggaatacctcggctccgtgggggtctggggaagacctcgcctccggttcagtgcgtggcggtgaaagaaagcgacgacctcgagggtagcggtggattgcggcggcggcggcggcggatggggacgacgtcggctcctgctgcggccagtcgcggcagatggggaagaccacggctccggcggtggttggggaagacctcgcctcggttcagtgcgcggcggaggcggtggagtgcacggcggcggcggcggcggcggcgacggaatgggacgacgacgcgaggaggagtgaggaggaggagcgagtcgcgtgttaagagggtgacgaggcgtattctttgcgcagagaccgtgcgtggagagggtgaaatcgtcgtcggagagggtggatggtacggactacacctgaggtgcgaatggacggtagggatttaacctgatgatttggcatgtaggattactagaggtgaacttctcctttttatattagtatatagatttgacatgtaagattgctagagggtgaactcctttttatacatgtaatatacccgtgctaacgcaatggtgataattgataatgcaaaaaccaaaaggtaatatttaagatcacgaataaaataacgatagagagatttgtattgttctcatgaatgttattatactgtcaataactttccaaagttggccatgaatggagttctgcaatattttcatcactctgagtgaaacatttcaaaacacaaacaatagctcatagtatctaactttttataccacatacagatacaaatatcacctgaaagttttacatgtgctattttttcaatacatgcatcgcctggaaatattcagcaacttctgctcctcactggtcaccttcctccttatagagcacctcaagaagccacatgaacgtctatatcgaacacatatcaggagaagcaccatattgaagacagtgcgttcgtctaccacgaggtacacgcttataaagacatattcatcacttagtattagtaatttaactctcaacatatttggtaaaatatcctggtttctactgaggcaaaaatatgtagcaaagcaaatatataggcattaagcatttaatagcaaatgataataaattatttatttgaactgaaagcgctaggcttttacatggctgcaattttgtttatgtaaatgagttaggtccatctcacagaacctcaatccctattgacccatattagaaaaccctgaatttgagtacaaccgttatatatataacacattaagatgtagaagacactaatttttatatcagtttttataataaactgattcgacaaagctaaccgggtccatttaccatttcataccattttaaacaaactgagagattagctcggagtcatctttgttcagatgcaaggaaagaataaaaataaatactgcaatgttaaacaaaccgagagatcaaaggccaaatagagccagcagcatctcttaatacagaaatatatgatcaaaccccaaagaaagcatgcaccatttaatttctaatttggatgaatggcaatcgagcccattgcctctacatataactttgactgtacattaagagaataggcaagcatgcataggtggtacagtggcaaacagcagaaacggatcaataataatataattctcactcatattcttgtaaactatttaattctgatatataataaaatccagtatcaaccaaaacttttgaaagtgcagtgtgacagtagaattcttctgtttgactttttttgttgaatagtttcagcatatttggttctattttaaatgaacaacaatagacaggaaacctattcatctagatcatagcattttataaacctatgcatctggaagatcaatttgtacaaagcacattactctcttccatttaaaataaactactattttccatgaaggcaaggtataagttacaacgctatgatggcaatacattttaacacaagcaaatttatctatggtgccaatttgtaacaaaggcagaaaaactgggactatcagatcgtaaaaattttctaaacaagtgcataatctcggaagtgaagcctaacctattttctttaacagctaaacacatttgaaacaaaggcagaagctgagacacctgaatagaacaatttgttaagctatttctaaaatctagctgtcgaaacatgatttcggcaataataaaaaggggtagcgcacgagacctaaaagtggatggatgcagagacaaaggatttagacaggttcaggccctctcaatgagaggtaataccctactcctgtttggggatttgaatccgccgggtatgtattgatctgacgatcaggttgtgtcatctatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtaacccccgactatgtggttaatcgaacaaaccaaacatatagtcaaggaataaataatccaaccaaccgagtggttttgataattatagtcaaccaagcgacttaatattaatatgtagcatatgcggcgtgaatccctgaataatatgatccaagtgatataccgactgttttgtaaaatatgatgaatgtaacctaaagttggctacattattgaaaattcacatagcaaaacagctataaagaagcttgtatgttgtgaataaataaatttccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtcccaaaaagaacgtgacatgccacacctgaaaatatgggttgcagacatattaggcctaggccaaaaaatatgccttcgacaccctttaaaggatgacgcatgtaacatgctcccgagtaataaatcttccgggtaatatagaccaagcgtagctcatatgaatagcttctgatcttagtgattatcccttatgggatactccaaaatagatgtaacaatcgaatcccgactggcgcaagtattcagttgataacccttacggggaataataaatagtccagtctttgagtatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagataaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacatcatggttggtgatgtagcaaaacttgtgaagtagcagcaatagagtttgctggtaccgaagataataaagatgaagtcgctctaccatgatgacaaagttgcattgccgtgatgaagtgaacacgagtcgtcggcaacagaagcaaaccggtagtgaagacgcgcagttgtgaagataaaagcactagtcggcggcggcataacacgagtcggcggcggaagacgatgatgtccatcagtagtggtagctgtataaaccaaatgtagaggcgagggcactagtcagcagcagacgagacgaaaggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaagccagccgtgcaggcggtgacaccagttagcggcggatgcggcggccggtcggtgaagacgtagacgcccaacaacggcagcataataggccagccgtgcaggcggaaacaccagtcggcggcggtcgaggcggccggtcggtgaagatgtagacgcccaacaacggcggcataataagtcagccgtgcaggcggaagcaccagtcggcggcggacgaggcggccggtcggtgaagatgtagacgcccaacaacggcggcataataagtcagccgtgcaggcggaagcaccagtcggcggcggacgaggcggccggtcggtgaagacgtagatgcccaacaacggcggcataaaggccagccgtgcaggcggaaacaccagtaggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcagcggcggtcgaggcgagccggtggtggtgttctgactaatccattcctggagcgtaagagataagcttaaagccatgaatcccttttatgcatatctggatatggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacaatataacatctatagcccccgactcactagtcaacggcgaaccagttgatgtagtgaggcgaaggaaaagacaaaatatcatataaagaataaaataaatgatgacttagctttgtaatattccctcggtgacagcaaaagtagccgatgtgggaacgaagcagtccatcaatggtgacaaaaacaccagtcggcgccagtggaaccaagccaatggtgtagatgatgaagcccattaacagcggcgaagtccgccaatcgtataggcaaaaacaccagtcggcagggcgaaggccagccggtcggcgaagacgtggacacccatgaacggtggtgtgaccaaccaaccgtataggcgaggacaccagtcggcggcgacggaggcaggccggcggtgaagtcgtagacgcccaacatcggcggcataataggctagccgtgtaggcggaggcaccaattggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggtgacggaggcaggccggcggtgaagtcgttgttgttatcagcaatggcggtggcgaagacaagccggcagagtggactcgcggccgatcgaccggaaagttgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacggaaaggaagtgaaaactcccaaagcaaaaacgaagtcggcgactcatgaaattgattccatcgcgctcgttgataggaagctcaacgcagcccctacctggcgcgccaactgtcgaaacatgatttcggcaataataaaaaggggtagcgcacgagacctaaaagtggatggatgcagagacaaaggatttagacaggttcaggccctctcaatgagaggtaataccctactcctgtttggggatttgaatccgccgggtgtgtattgatctgacgatcaggttgtgtcatctatgccccctagagggcctcctgcccaccttatataggatggggggcaggattacaagatagaaaccttaaccaagacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacactagcaaatcaaatgaaatcaaatcagaaccatggagctgcattagtttgactacaaataagcatgcagatcgatgcgtgagaccctgggtgcagcggcgattgaacctgagatctacttctcttttttttttctgcaatgtgcccctatgccggtatgaagtatgaacacatgtgtgccgtcgttcacctatacagctccaccaatcatgtgccatcgtttttattgacggaagagtagaaaaaaaaatctaataccatagggagattgatttattgcaaggagcagggtaatctggagatggcaaattacaatagaaaataattaaacttactagccgtgaccagctgaatttccagccagtataggagcatctccaaacctccaattatgatattttggctattattataggtctcgagcaagcaaactgatgttgcaatgattttagcttcaaggaaaaaaaattggggacaaatcagctgcatgctaaagatgccataagatttacaaaatgatcagagagccatgatctgactctatccctcccaaggttgcgctcctgcagaacaaaaaagagacaataagcaagtttcaccagcaaaatgcgagaaacgaataataactcattgcacagatttcaattggcaactaaacgttgaagtttctaggataaaatttaggggaaaacttactgccaacatatgggaatttgcctgtgcaatctgccagttagcgagccacaacttctggcccattcccgctcaactctatgatcttgctgcatgcaccaaaacaaagcaaaaatataatcaaaccaagagcacatagcatcaaaagcccctgccactcaaagcctcaacagaagggatgaactgatgcagggaatcaagtacagggacgtactccctctcctcaaggagctccataggttccgagttctcctggaattggcacaaaatttagaaaaaatatcaccattaaattagtagcaatctcatgaggagatcgagattaacagagagagataggatcttgccctgaccagctgcacgattccctccttgcccgtatccgctccacacaccggtccgtcatggtccatgggtgtacctcctcattacagccccgcccttggatatcgagctcatgccgttcgcggccatcctccccggtgcagtggcggcggtcgcctccgcctccactgctagcagttctaggatggcgacctggtggggagcaaagatggcggcctccatggtggctcgtctcaatggaggaggtgcaatggcatccgtaacccgcagtgccggagcggggtagggtttggggagtggtgcggcggtgataggcgaggggcaggggcgtgccggcggcggggtagggtttggggattgggtgcggcgacggttggcgaggggcaggggcaagaatcgcggcagtgatgggtgaggggaacggacgagaatagcggagcgcgagagagaagggtgtttacacccaaatttggcacctagagataaaataggaaaaattgccaaagtttggaagtctgccggttttctccgagtgggccggtctgaccactgtgtgttgagcggtcataccgccggttgagggccggtcagaccggcggcatgtggccggtctgaccagcaggtccgagtccgaatgtgtttcgtcgggtctcaaggtttccttgctcgggaaggcacgtttcgggtttcctttggtttctaccccgagttagacgtggaggagggcctgtagagggcaagaccaacccctatataagggacatggccggttcaattgtaactaatcaatctacaatcaaccaatcgaatcgtttttcatattgcttttagttttctcttagtttgtccatctttgtcgatttgcgctgtaaatcgtccaccgccgctgcgagagtgcaacatctctttgtaggtttgtcatgaaaaccttccgttttcccacgagacgggtagttatctagaaatcggctccgctagcccgtttagttatcaaaacccatgttggtctagtttttgctagatcgaggtggttggcgactctaagatcaccgcaaggcgtaaggtgctgcgatcgtgcttgtcaacttgttataaaaagttgccaacatgatttttggcgactccgctggggaaatctattcaacgtcaactcaacttcaactttgccatgacgaagtcgccgccatccaagtcggaggtggatccatccaacgtgatgccggttacgagggagagtcttgatgaggaagcacgcaaggccttcgatgaacacatgaagaagtacgccgacgagcttttgaagacatgtacaaagactcgtcaaggcacgatcttcaagccagatttggtgtcttcatctactattgataaggtaacttttgaggatttatcgcaatctattcaacaacaagttgctcatacaatagatgaatctatgattgttttaaagaataagttagaagcatcttttgaaaacaattgtgaaaattttatgagaaataaactcggccctctcgtggccgattttatattcaaagataaagcctctaccagtgctagccaagctcccgtagatcaaataaatagtaaaaccgatggagcaaagacacaacaaatcggcgagggtttttcggcgcaaactgccggtcagaccgggccagatggccgatctgaccgggatgccgccgccggtctgacaggcagatgaccggtcagaccgagtattactccggcggtcagaccgggactcaggccggtctgaccgctcctctggatgctggtcagaccgggccctggaccggtcagaccggcgcaatagtgccgattcagggggtagatccaatgactaatgctagttatttgtatcatcttagaatttttgatcctcctgtatctactgctgcaaataatccccaagttcccccacatattcctaatgcttataatgatgtttctagggggtatcctcctgatactaggcaaggccaatataatcatattgcgccgcaacaccaacctattaggcaaccaaatccactaccaaaccaacataggcttgataatatggaggaattgattagtgggattattagggataaatttgggattgaagctaggaattgtgctaaggtttaccaaaagtcgtatcctgattattatgataatgtgccatatcctcgtggtcatagggttcccgaatttaccaaatttagtggtgaggatagtaggaccacatgggagcatgtaggtcaatttttagcgcaatctggagaggctaatagtgatacttttaaattgcgcttattctctttatctttgtccggtactgcttttacatggtttacttctttaccggcaaattctattcatacttgggctcaattggaacaaagatttcatgattgtttctatactggtgaaactgagcttaggttatctgatttaacatcggttaagcaaaagtataatgaatctgtcattgattatgttaagagatttagagatgttagaaaccgatgttatagcttgaatataactgatagagatttggatgatcttgcttttaatggtttaattgctcctattaaagaaagatttgatggccaacaatttcttgatgttagtcaactcatgcaaaaggctttggctcaggaaagccgggttaaggataataaaaaatttgttagaccatatgagaagaagcctaatgttaatgcaattgattactctgaagctagtgatagtgaagatgagggtgatcatgatatgtatgttgccaagtggtcatggactaacaaaaataagccttttgttcactctaatttaatgccgactcctcgtaaagatcggcaaagtgaggttaaatatagttttgatgtggccaaatgtgataaaatctttgattatcttttgcaagaaaaacaaattagattacctaaaggccatatcataccttctcaagaagaattgaagcgtcgagcttattgtaaatggcatgattctcattctcattctactaatgattgcaatgtgtttcgacgacaggttcaatcggccatggatgaagggcgattgaagttcaccgatggttctaagatgaagcttgatcatgatccttttccggtgaatacaattaatttcaatgataagaaggtgttgattcggccggagcaagccgaatctactaaggggaaagaagtgatcattggtgagcctaggccaaagatgatagtgccaaagaaaccggaggttggtctgtggaaggagaatgggagtgaggcttcaacttctaaagctcctaggaagactaaggcgactttggatatgcttttggagaagtatgagaagcaaggtgatgagagagctcgcaacaaaggaaaaagaccaagatcacctcctagggagcgatttggccattcaccaagacggtcgcaatcacctccatatcatcattcacaacacatgtcatgggggccttacccaatgccgccgccgggttatccttatctttactacatgccatggggggcaacaccgccaatgttcaatcatatgcctccaatgcaattcaaccaaaggtggggaggaccaaggaggccaattcatgagcgcttgtcttcaccaaataatagccggttttatggaaaaaatcaggttaatgaagaaaagagggaaggaaagcgtgttaaggtggaggcaaggacttcggaggtgattaccatcaaagtggggtctcatgatgtgccaataccttcgggagatggagttggggagtcctcaagcaacaaatccgaaaccgggaccagctcatcgcagtcggccggtctgaccgggccctctggctggtcagaccgcagctctacggacggtctgaccgggccatcaggccggtctgaccgccggcctcaggtcggtctgaccgggccatcaggccggtctgaccaccgaccccatgtcggtctgaccggcgcatctggccggtctgaccggtggtctacgtccggtttgaccggtctccagcgctggtttgacaagaggttttcaaggagtagtgcgggggcttcatcgtcttcaagtaaactcaatagggggcattacttacctcctggaacagagccgaaacctaggtggatgcctaaggatttaacggctactcaaaggagaaggttgcaacatcttcgggcccaagagatgagagagaaaaaggccgaagagcaaagagataagagattcaatgagttgcgaccaccaccggtttggaggcgtaaatccgtagagaaggaagaactggttgttgtagaggagaaagaagaacaatcagttgctaaagatgagtcatctccaaaggaggacatggatatcaacatggtgtgtatgttgcctatggagttttgtgctatggatgaagccgaggttgctcaattttcactaggtcctaaagatgcggtttttaagaagcccgatgaatcaaaccgtcatatgaagcttctctatctcaaaggttatgttgatgggaagccggtctctaggatgctagtagatggaggtgccgccgtgaacttgatgccgtattcattgttcaagaagttggggcgtgaggatgatgagttgaagaagaccaacttgattcttaatggcttcaatggtgaaccaacggaggcgaaagatatcttgtcggtggagcttaccatgggaaacaagacgctatgaaccgctttcttcatcgccgatgtgcaaggtaactacaatgttattttgggtcgttgttggatccatgccaattgttgtgtgccttctaccttgcatcaatgtttaattcaatgggacgacgatgatgttgagattgttaaagcggatgcatcggccgaggttgcaatggccgatacaacgtttgactggcgtcatgggaatattcaatgcttatcggggagggatctttctagctatgatttcattagtatttcgatggcaaatttgtacctatctctgtaaagccggctagtgtagcacggctaggccatataaatttgtgtaatgagtaaagaagctaatttagagtggttgcaaaagagggtgcaagaatatcggtctacaaagaacgatattggtgagactattgaagattttgatgaagtagagaagcttggacaagggtttacatcggccgatccattggaggaagtagacataggtgatggaactaagccaatgccgacttttgtaaacaaaaatatgagtgccgattataaggttaaaataatcgagctactaaaggagtatgtggattgcttcgcatgggaatatcatgagatgccgggtcttagccgtgagcttgttgagcatcggcttccaatcaaactgggttttaggccttataaataaccacctcgtcgttttaatcctttattatatgaccgagtcaaagaggaaattgatcggttgttgaaggcggggtttattaggccatgtcgttatgcagagtgggtttctagcatagtcccggtggagaagaaggggagtggtaagattagagtttgcatagactttagagatttgaataaagctactcccaaagatgaatatcctatgcctatagccgatatgatgatcaaagatgcctcaggtcataaggtaattagtttcttggatggtaatgccgtctacaatcaaatctttatggcggaggaagatatgtacaatacggcttttaggtgcccgggatttgttggtttgtttgagtgggttgtcatgacttttggattgaagaatgccggtgcaacatatcaaagggcaatgaatttgatctttcatgatttgttaggtattatcttagaaatctatattgatgatattgttgttaaatcggatggtatagatggacatatagccgatttgagattagcttttgagaggatgcgccggtatggtttgaagatgaacccacttaagtgtgcttttagcgtgtcggcgggtaggttcttaggattcatggtgcatgagagaggagttgagattgatcctaagaagatagaaaagattcgagatttcaaagcgccgacatgcaagtaggaggtccaaaagttgcttggtaaggtgaattatttgagaagatttatttctaacctagcgggtaaaatcgatgcttttgtccctatacttcgcttgaaaaaagaagccgattttacgtgggggggggggaaacaacaagaggcgtttgaagggttgaagaagtatttgtctactccacccgttgtgcgggcgcctaaagccgaaaagccttttcggttatgtattgcttccgaagataaagtcattggtgccgttttgacacaagaagaagatggcaaggaatatatcattacatatttgagccgccgtcttttggatgccgaaacaaggtatgtctttatagagagactttgtctatgcttatactatgcttgtaccaaattgaggcattactttttatctagtacatgcatagttgcttgtcaagccgatgttattaaacacatgttgcaaaggccaattctaagtggaagaattggcaagtgggcgtatgctttgattgaatatgatttggcttatgaaccgttgaaatctatgagaggccaaattgtatgtgattttatagtagaccatcatgtagatattgcttatgaggaagaggtttgcttatttgaagttataccttggaagatttattttgatggttcttcatgcaaggaaggtcaaggcataggggtagttttattttcacctaatgggtgtaaggcatcggttcgtttggaatattattgtacaaataatcaagccgaatatgatgctttattattcgacttacaagtgatggagatgattggagctaaacacgtggaagcttttggtgattcggaattggtggtgcaacaagttgccggagtctacaaatgcttggacggatcactaaataggtatcttgactcatgcttggatattattgccaattttgataattttctgaccggttctgagcagagcgctgggggccaagccacaactgatttaaaggccgaattgattgtaacttcggacatttgtgcccaggaagcaaaagaagattggagaattcctttggttcgatatttgaaagatcctacacttaaggttgatcggaaaattcggcgacaagcgttcaaatatacattgcttgatgaagatttatatcgccgaaacatagatggagtcttattgaagtgtttagatgaagatcaatctaaagtggctatgggagaggtgcatgaaggaatttgtggaactcatcaatcggcccacaagatgaattggttgcttaggagagcgggactctattggccgaggatgattgaagattgtttcaaatactatagaggatgcgaagcttgtcaacagttcggcaatgttcagttggcgcccgccgccgtgttgaaccctatcatcaaaccatggccattccgaggttgggctttggatttcattggtcaaatttatccttcgtcatcaaaggggcataggttcgtgctagttgctacggattacttcaccaagtgggccgaagctgtgccgcttaagaatatgactcatacggagttaaatgactttattttgaagcatattatacatagattcggtattccgcaaatattaactacgggtcaaggtgcttcttttatgtctaaggaagtgaagagttttgccgaatcttatggtaacaaattgttgagttcttctccttactacactcaggctaatggacaagccgagttgagtaataagacgttgttgaagatagtaaaaaagaagattgaggaacacccaaagaggtggcatgaggtgctttctgaagcattgtgggcgtataggatatctaaacatggtgccactaaagtcactccttttgagttggtttatggtcaagaagccgttttaccagttgaggtaaatcttggttctcttcgttacatcaagcaagatgatttatcaagtgaagattacaagatattaatgggagacaaccttgatgaagtcatcgacaagcgtttgaaggctttggaagagatagagaaagagaagaaaagggtggccaaggcgtatagaaaaagggtgaaagcaaagttgtttcaagttggagacttggtttggaagacaattttgcctttgggtactcgatctagggaatccagtaagtggtctcctaattgggaaggtccttatcgagtatgcggcattgttcgagggaacgcatattttttggagacacttcaaggggagcgttttcagcgagcaatcaacgggaaatacttgaagaaatgcttcccgagcgtttggcaaaatgcttaggaggtgctatggccggtaattggattatcgctataagaccaaaaacatgttctatgcttttagattcacgttgttcatcaaaaaggcagggggcatgtgtttacacccaaatttggcacctaaggataaaataggaaaaattgccaaagtttggaagtctgccggtttcctccgagtgggccggtctgaccgccttgtgttgggcggttagaccgccggtcgagggccagtcagaccggcggcatgtggccggtctgaccggcaggtccgagtccgaatgtgtttcgtcgtgtctcgaggtttccttgctcgggaaggcatgttttgggtttcctttggtttctaccccgagttggacgtggaggagggcctgtagagggcaagaccaacccctatataagggacatggccagttcaattataactaatcaatctacaatcaatcaatcgaatcgtttttcatattgcttttagttttctcttagtttgtccatctttgtcgatttgcgctgtaaatcgtccgccgccgctgcgagagtgcgacatctctttgtaggtttgtcatgaaaaccttccgttttcccacgagacaggtagttatctagaaatcggctccgctagccggtttagttatcaaaacccatcttggtctagtttttgctagatcgaggtggttgacgttgattgaaggaactaaatcttattcgatcggctgtagatattaacgatatatagtccttacatcgatatatactaaaatcaagtgattgggatagatcggtcgccatgccgagacagtataaatcacttagatcgaaatatatattaataataagactatatatgttcatagcatagccgatcagatagatctagcatgtatcggctaatactccgatactactctatattaagatattagagcaagtagaatatactaaacaaaagcctaatatacttaaatgcaacaaaatcttaatataaatggcagattcaacatatcaatgaagtatataagggaaatatagtgaaatcaggtaagatcggctgaaaccccgatgctaccctaatcggcaaccaagaagcaggctagagattgagattctaatcacgactcataagatcaaactcaactaatgcagctataagtatgaaaagaaggacaatatctagacaatcaagccgttggatgtgtcatagagtggtggatatcttatataatctaagtcaacatcggtatttaacctaatcgactgccttctattgacagatgttagccgattgtaggttagatatcgatatcgccagagattatgtatggtatatgataactcgacgaattacataaacaagattagagtgtcataaagatggaagcactaatcccgagaacgcaagccgccataacaagttttacctcttgtggaagatcgaaaccgatgcagctcaacccgaaagcaagaactcgtcgaaacaaaacgaaagtaaaagggtggcgatgcgccgagattgtattgaacgtgtgtttattcgattacatggggttcgggtctatttatacccgagaattacaaaatatgtccataccagacacgactcttatctgtaacaaactctaagataccataagtcttcgcggcagacttttgcccaaacttatctctaaggaaattacataaaatatcctaattaatagatacaattgacttctcaggactctatccatacgccgcaatcatcatgaagcacatcaacctaaaccgacaacgtttgctgcatcatattgtcggattcggctcaatcggctaacactgtccgactcgaactctgccggtcttagccgtagccgattcaaacttcagccgattcttactctgttttcgcgacgctcttcatctttgattccgctttgatctaatcttctttttcgatgctgacattaccaaatttggtcgttaacacatgccccccaagtccggaatattggataatgtttcggatttgccatatgtcgattccgagagaaatccgctcttgccttttcccgaccgttattccagcgctttaaatactaaccgttacccccgagaaatcacaccgtcttctcccgttttcaccgccgaaaccaactatgctttctctctctccggcgatttctccgacacacaaggcgattcccaggcgacttcatctccggccagatctccgcctgcggcgatgtcttgttccgccagcccatctgccgcgccattagccgagtacactgaggtaagttctcatcggctagatctctctcttttgcaacagattagttttctcctgccttatattgttttcttcttctctattcctgattgcatccgtagcatctgtccaatcttgttgcaattccaagtctgtcgcatgacaaccactatttccttggtccaattggtgattccgaccctactgaattcatcattgccaaaaccaacagaatcccctttagattagcgaaccctaatctgagcgattggaagaacaccttcaagtcttggccatccctcgagaaaacctcccctgagaaaagctggaccacatggtataagcgcgtatcggctagcaagcaggttcattgggatgaaattggaatcggccaggtactcgccctcactatagccaattcagctaaggatgagcccctaatggcagctgcctcttacttctggtctagtgccattaatgcctttttgttcaaccaagggctgatgaccccaactgtgatcgacatcaccatgatcactagattagatgtgacttcatcggctaaccctatgagtttgaacaccaagaaccagtttgatttcaaaaccaaaagcataggtggttggtctggttatgtggcagcatatatgggccaaggatctgtcactcctagggaacatgtggctttcctgctcatgtggttagaaaaattcctcttctgcggaccaggttgtggtcccaccaccaactggcaattcttagccgaagcccttgaaacaaaaaggcaattccctttgggtaaaacccttctcggctacttataccaaatgttgaacaatgcatcggccaaaatagctatcggctcagtggttggagcaggaggaccatggtggttattgcaatcttggctaaatctggtagttatgaaagccgttaatcggccatctgtgacagaagctgaatttccaagactagagccgattgcagatgatgatggagaagaacgcacccaccgcaggtgtatgtcctatggggaatatgcatccacaccagccaatgcaggagcaaagttatcggctgagctgctcaaggactggttctgcagcttttatgaaagctttcaaaaagatgcacgtgtttggttcttctatgagaattcagccgacttggatctcccatcggactttagattcgaagacatcaatcatgagagataccaaaaatctatagaagttttctcaacttcaatcagcccatgtatccttcctgttggcattcatcaaggaagaaatatacaagtttcttatgaattctactatccgatgagctctgccagacagttcggaatgggacagctaccgggagaactccatcggtttctcctaagcaaactcctccaactccttctgctctagcccatttttcaagggtaagcaaccgcctctgattctttttgcaactttctcacttatagccgattgctcacagattttatagttgcaaaaaaagaaaaccgctgtaaagaagaaatcggcagcaccatttcccaaatcggctccaccagtgagatattcttaattcttttagtagttgatcccagctgatttttcctaatacttatctttttgcagcctcctcctcctccttctcctcctgttcagcaactatcaagcgatcaaaccccatcggctgcagggagtcaccatgttgaagaagaagtacaaccaaccactcctgtcatcccagtaagtcttgtctataaaaatcttgaatcggctgaacaactcatcttgataatcaactgtcttcaaatttcctcctgcagatcttagccgatttattctcttttgacatcaaggattactttgatgaggaagcaaaagaagaaacatcaagcaaaactctagcccctctaaatgaagatgtcaagaaaatccttgaagacatatgtcatcggctagggtcatcactggacagtctggtggccgattgtggttcaatccaggcacgatttgcagaaatccaagctttaatcccagatgatctagcgaacaccatcactccagctgcgtaccttgagcaacatcaattcaagctggagaaagctaagcaacggatagccgatcgatgggagcgaaaagacattgaagccactatccaagccaatcggcaacttgtacatgaagaaaaattcaagcttgatcaactgtctgaaggtccgatcaagtccaatattgatcggctcgaagcccgcaagattgagctcttggctcaacttcaagaatgtaatgccgaactggacctggaacacaagaagctagccgatctcccgcgagttattgaagaacacaagacaaggctgaaatcggtcataaaaaacgttgctgatatgaccaagtccttgaaaatcatccctggaatcgatgctcaagatgcccaagctattgaggaggtagaacaaattaggcaaagggctatatcggctatccagcaatatttgtctcagtgacttcttgtgtaataggccttaggaaatttttgtaatcggctaagatgctttggtactatattcaactgtcttgacgatcctttgtgccgattaatataacttcttaacttgctcaaaaattttccaaatttgcaacttgtgtatatatgtgcccccctaatttttacaatgtcaaaagtattgataaaattatagtttgaactaagggcgatataaaaatatcgaccattgtatattggcaaaccacaaccggttacaatatgaaaaacaactaagggcgatataacaatatcggccactgtagatcggcaaaccataaccgattacaacataaaaaaacaactaagggtgatataacaatatcggccatctcaaggcgatgcaaacacatcggctatcacgtatcggcaacactaaccgatcatgcattaacccaaacacttgggtaatatttcttcaaatattttccatttagcgctcgtccatatacttctccatcgagtccttgcagcatgtatgctcccttagacacaaccttatgaatctgaaacggtccttcccaattcggcgaccacttgccgaatttattatcccgagtcccaatcggtaaaaaaaacttccatacaagttcaccttccgaaaaagtcttaggcaccactttcttgttgtaatgccgagcaattcgttccttatccctggtaacctttgcaagggcccttaatctagactgaacaagtcttccctttcatcggccatgaggttataatactcatcggctgttaaatcattttgcaattccgttctccttgagcggattctaacttcccatggcaaaacagccttatgtccataaacaagcttataaggcgggacttggatcgatccatgacaagccatccgataagacaacaatgcttcggccaaccaagtatgccattgccgaagataatcggaaatcttcctcttaatcaacttgatcaaactcttgttagacgcctcggcctactcattagcttgtgcataatatggtgaggaattcaacaatctgatacccatgctatcggcaaactgaacaaactcatcggacacgaaaattgaaccttgatcggttgtaatggtttgagggataccaaatcgatagattatatgttcttgaacaaattgtatagcgtccccagaatcaaccgtcttcaaaggaatcgcctctacccacttggtaaaataatcggttgccaccaatataaacttatgtcctttactcgacggtggattaatcataccgatcatatcaattccccaacctctaaatggccatggtttaatgataggattcatagccgatgccggtgccctttgaatcgccccaaatttctaacaatcttgacaccccttataatatttgaaataatcctctagcattgtcggccaaaaataccctgcacgtcgaagcaaccacttcatcttatgagccgattgatgagtgccacaaatcccctcatgaacttctccgattgcgaccttggcctgatcggcatccaaacacttaagcaacaccccatcaattgtccgataatagagctcattgtccaataaagtatacttcaacgccttatatcgcaacttgcgagaagccgattgagatggattttgtaaatattgatgtacatcatacctccaatcatcggatgtcaacacaacaacctcaattttaacatccttgatcatcggcttatatcccgatgccccttgggccaaatcattagcttcaatattttgctcgcgagatacatgcttcaaagtcaccagccgaaattccttcatcagttcttggcacttttcattataaactattaacgtatcattcttgcactcatattctcctgccaattgactaattactagcaaagaatcccccataatctcgatagcatcggcttcaactttcttgaataactgcaaccctttgagaactgcctcatactcagcttgattattggtcgcataaggtttaatagtataagcaaactcaaaacatacccctcgagggaaaattataactaagccgataccacaaccatgagtacatatggatccatcaaagaataaagtccatggcacaatctccactgagtcgattgaatcatcacgatgatcaactatgaaatcggctatagcttgccctttgaccgccttcggtgactcataccgaagatcaaactcagttaaagaaaatatccattttccaacccttactttcaaaattggagccgataacatgtatttgacaacatcggccttgcatatgacagtgcattcgttggacagtagataatgcattaaccttgtacaggaaaaatacaagcacaagcacaacttctccacaggagagtatctggtttctgcatccaaaagccgacgacttaagtaaaatacaaccctctcctttccttcaagctcctgaatcagaaccgagccgattgacttctctccggccgacagatataatctaaaaggtattcccttctgtggaggaatcaaaaccggaggagagctaagatattccttaatgtcatccaaagctttctattgctctaccccccaagtaaactgttgatcggctttcaacctcaataatggtgtaaaaggctctaaccgtccagacaaattagaaataaaccttctgacaaaatttatcttgtcgatcatctcttgcaacttggttttattttctggaggctgaattttcttgattgcattaacactcctctgagttatctcaatcctcctctcatgaacaagaaatcccaaaaactgaccagccgatacgccaaaagcacactttgtcggattcattttcaagccatatttccttgttctctcaaaaacctttctcagatcggctatgtggtcctctatttccttagacttaacaaccacatcatcaatgtagacctcaaccaaccagccgattagatcatgatatatataatccatagcccgttgataagtagctccagcactttttaagccaaaagtcattacaacccacacaaataagccgattgcaccaggacacctaaaagccgttttatggatatcttcttcggccataaagatttgattgtatcccgtattaccatccataaagcttaaaatcttgtgccctgaagcagcatcaactagctgatcggcaactggcattggatattcatcctttggggtagcgttatttaaatctctaaagtcaatacacacccttaccttaccatttttcttgataacaggaactatactagaaacccactcggcatatcggcaagtacgaataaaaccagcatcatatagacgtttaaactcagccttgacaggttcaagcatatcggctttgcatcttctcggaggttgttgatgtggtctaacccccggtttgataggtaaccgatgttcaacaattgatcggctgagtccgggcatctcataatattcccaagcgaagcaatctctgaattcctttaacagctttatcaacttggttctgaattctgaagataaattcttgctaataaatgtcggccttggtcgatcacctggacctatgacaatttcttccaaatcatcggccgacatgaaaccctgtccttgcttgttatcgagatcatctactatgtccttggtgtagacctttgaaccctccacgatgccctcaaaataatagcttgggttctccatcttcaattggttgtatatcagaatcggacacttttagaaaatctccatcccaaacttttccagacaaacaatccaaatcatccatctcccaaagagctaaatcggcactggcaacgttgactgacctgtcagctggtacaatctcaatcttgtcgccttgccactgaatcaagcattgatgcatggttgaaggaatataacaattagcatgaatccaatcccttccgagcaacatgctgtaagaacccttcccatcgatgacaaagaaagttgtacggatagttttgttgccgacggtcagctccacattcaaaactcctttggtttctgatggattgccaccaaaatccttaagcaccatatttgtcttgatgagatccttagcgtctctgcccaactttctgaatgtagcataagacatcaaattcactacagccccaccatcgaccatcatcttggacatcggcttcccattgatataaccatttatatacaacggcttgagatgccgattttctgtaccctctggcttctcgaagactgcctgttctggtgacaatgtcaatttagccgattcttcttcaacttcatcaacatcggcctgcttgaccccaaactctgcaggcaacgtgaaaaccatgttaaccgatgcaattacaacactttttcctttggccaatctttttgcttcatcagctgtggcttcatcggctgcaggaacctaattcataacacgccactcctgctttggctttgttttctttaaccgatgatcgatttcctgttcgacctcctgaaaatgctcccgactcctcaatctttgaacccttctcttttgattctttgtaaaaataccagaaggacaccattgagttttcctgttttcattgtcctcctggctacgatcttggtttactggacccaatctttgatgaacaggaactcttttctgcctcagccgattgcctctattacatgatcggcttgaactctttgttatatcactgcatccaggacagtcctcaatagatggcagcctcataccttcattccaacaaaatcgaaaaaactcacaaccccaatgaggatcaaagccgtcatcgttttcctcataatgtttctcctgctgcctgtcatatcttttctgatacttcctaataattttagccgaatttgactgaaaacctcttgcacgtcctccattggctgtttgaccagttgtatgcaccatattaacaggaaaaggattgccatcaaccttcatcggcctcttagaatcatcaaacctaattttaccgtcctcaatagctgcttggatttgctgcctgatgaccttgcaatcattggtagtatgagacccggaattatgctacttgcaataccttttcttgcccaactctttggccgatggaattgtatgaccagcaggaagttgaatctgtttctctcggagtaacaaatcaaaaatcttgtcagccttggtaatatcaaagtcatacctctcctctttcccagagttctttacccattggcatagtataacctttttgcttctcacccattcggctgttgctatctcagagtcatcaccatcatcatccaatccatacatgtaaggacaaacgtgattaacctttctagagtttttcctggactctgcaaacctctgttcatgcagggttaccttctgtgtaagatgtgacaagctatcaaagtctttagacgagaatttctccctaatcggaggaatcataccctgaaaagccaaatcgtctaactgggcatcagtcaaactcaagctataacacttattcctcatctctctaaatctctgaatatactcatgcacaggctcatcatgtctttgcttgattgctgttaaatcggacaatttcatctcatgtaccccattgtagaaatagctataaaaatgcttctccaaatcggcccaactgttaattgatccatatggtaaagaagaaaaccaagtaaaggccgatccagacaaagacagtcggaacaatctaacccttaaagcgtccacagccgatgcttcaccgcactgggccaaaaatcggctgatgtgttcataagtcgatgtactatcctgccccgagaattttgagaaatctggaactttgaaccggttaggtaaaggaactctctcaaaccattcagggtaaggctgtcggtataaatttccagcatctttcggcctaagcccgaactgttccttcattacacccgcaatcatatcggcccatggttgttgctgaggtgttccttgaggctgttgtgtcatgggctcgaattgattgtattgaggaacaaactaaggttgagccgatcccccctactgatattgaacttgtggtgatggaggctgatactgataattcaaattgcctccctggtaactctggaaatttggcttaatattgcgtaccaaatgctcgggaacaacttgaggtatcaccgtttgatctggctgtacatgatgaactaggtgctctgggacaactcgattcacagcgtgctgtcctagctgattgttagatgttgcaaacccagccgatgcattcatcaaaccttgctgttgaatcggctgaacaatctcctgttgtcttaacggtgtttgctgaattggttgcaaaacctgccgtcttggagggatctgctgaattgactacacaacttgctggttgggggtgtttgttgaatcggctgtgcaacctgctgccttggtggtgtctgctgaatcggctgctgctgggtcgggtcaacattaggttgaagaggtaagaacatagctacaacctgatcttgcgttagccgattcacattttgtccactatgctgtggttgctctcataccaacaaccgaggattgaccaattgacccggtgctgatggcaatgcagcaggtgcaggagccgataccggtgccgtcgactgagccgatggtgcattaggaggaattgactgagcagctggctgattatcagtaattaatggccgataattttggaatactcctcccagtagataaaccgaccctgtagcttgatactcagccattgaaccatcaaccatttttttcaccatattcgacaaagtgttgactaatattccagattgattgatcaaagcatggtgcacaacatagtcaacctgatcttggaagttgttaaactgtaactgtgctgcgttaccatcttggttaagattaccgccttgaactccctgggaaccatcaccttgaactccaacaccttggaccccttgagagccatcaccttgaattccttgaaaaccatctgcaacacctttatcacacggttgggttgtgccatctggaacttgctgtacttctccatccttagaagaacctgttccgggaatatcagcaactaccttcaccttatacttctgcaccactgtccccttgcgggtctgcatgaatgagtttaagaactggttccgtgcttgctgcatcattgagtcaaaatccttctgttgatcaggtgtcaacttgtctggagtaatggtcacgatgttgccttcattaatctcagataagcctagctgctggatcttttctttaagagaacctggactagccgaggacggcgatgctggcggcttctcggccatggagaaaactgctattgtgattctaacttcttaatgaatcccaccaggcgtgccaaaagcgtgttgatgtaaaacacgaggcctgggacatctgcttaactccagtgcaggttcaaaactcgccttcgggtatgctagcgtgccagttgatttgatcctgtaatcaacaagaaacaaagacaaagaaaccgcggttaaatccataaacgatagccgatcggctaggtgccgatgacatatcatttatatttgagccgatgtcatatatgcatcgatcgacggtcattaataaataagaaggaactaaatcttattcgatcggctgtagatattaacgatatatagtccttacatcgatatatacttaaatcaagtgattgggatagatcagtcgccatgccgagacagtataaatcacttagatcgaaatatatattaataataagactatatatgttcatagcatagccgatcagatagatctagcatgtatcggccaatactccgatactactctatattaagatattagagcaagtagaatatactaaacaaaagcctaatatacttaaatgaaacaagatcttaatataaatggcagattcaacatatcaatgaagcatataagggaaatatagttaaatcaggtaagatcggctgaaaccccgatgctaccctaatcgataaccaagaagcaggcaagagattgagattctaatcacgactcataagatcaaactcaactgatgcagctataaatatgaaaagaaggacaatatctaaacaatcaagccgttggatgtgtcatagagtggtggatatcttatataatctaagtcaacataggtatttaacctaatcggctgccttctatcgacagatgttagccgattgtaggttagatatcgatatcgccagagattatgtatggtatatgataactcgacgaattacataaacaagattagagtgtcataaagatggaagcactaatcccgagaacacaagccgccataacaagttttacctcttgttgaagatcgaaaccgatgcagctcaacccgaaagcaagaactcgtcgaaacaaaacgaaagtaaaagggtggcgatgcgccgagattgtattgaacgtgtgtttattcgattacatggggttcgggtctatttatacccgagaattacaagatatgtccataccagacacgactcttatctctaacaaactctaagataccataagtcttcgcggcagacttttgcccaaacttatctctaaggaaattacataaaatatcctaattaatagatacaattgacttctcaggactctatccatacgcggcaatcatcatgaagcacatcaacctaaaccgacaacgtttgctgcatcatattgtcggattcggctcaatcggctaacactgtccgactcgaactctgccggtcttagctgtagccgattcagacttcagccaattcttactctgttttcgcgacactcttcatctttgattctgcttcgatctaatcttcttttccgatgctgacattaccaaatttggccgttaacaaggtgacggctttttatagcatgaggaatgacggttgcgacggttggaaaggtctgtaataccctccaacgaccattgggagtgaatccccaccgtcagattgaaatctttcatccagcggcgcaaagggggttcggccgaaccaatggcccaaccggccccgctcttcagcaggccgtctcctcgtgggctcctcaatccagatcagtgaattatgggcctatttgatcgtgtcaattctgagtttctggcctatctctccacaagtctgattcttgacagcgtctgattgattgtccgagtgttttgctgtcggttctcctccattttgtacctctttctctaaggtagatagaattcatgtacaaatggaaatagattattctaaaacaaaatatacattgcaagcatagctagttctcctttattttagctatattgacagtcggaattggtcaataacgaccgtcaacaattttcaaaaatgactgtgaacccaaaaacgcttctggaaattttcggatttgtccgaaacattttcggaatctcctaaaaatcttcggttgacttcactgttttgctgttctggaaattttcggatatgtccgaaattaattttcagaattttcgaaaaatgcaattattgggcataacaggcaaatctggagttgtggctataaatagcccactccccttacttgtgagggctgctggtcacattggatattttcatgcccttggcttgttcatcttcagattcacttttgagtcttgctttcttgtttccctctcacttgtgtttgattcggattttggtctgtgtttgagagttgtggattcgagtttgtgtgtgtgcttgttgtaggcttcgtgaagatttgtgagcacttgcatcatctccgggagttcctttgattatttattactcttggaggttgaggactcctaggcggctaggtgtcagtctcgagtcaccgatctacgtgtggtaggccaggagaagtttgtgaagatcggatctcacctccgaaagggaagagataccactagtgaaaggaggagtgctttgtgcaacctcttgagcaaagggttagtggatacccgactctttgtgagctcgtcaacgtagagtagaatcccctcaaggatttgaactcagggaacaactcatcgtgcaacaactttggtgatattacttccccctctcctctagctttgcttgattgtgtcgctaaaggtctagttgcttttcgtgatagcatattcttgttgtaggcagctaaatctagaatttactttgttttgcgcatactctgctattttcggaaattccgaaaatccctacttccgtatttacttgagtttttgaattagcctattccccaggcctaattgaccctttcataaacctcagcgccattttagctagcgctaagtgcccagccagggaccccgcaacagggttgtttggcgagccgggcggcagcggctaagtgccgaatgtcagcgccaaggaaagtggcgctgagctgtagatgtcagcgccaagctccttggcgatgagacccctgccacgttggctgggccatgctggcagcgctcagcgccaaagcggttggcacggatatggccaagctccgcgccaggaggcttggcgctgagcccatggcctatttttggttaaagttctttgcgcgggctaatttcgtaataagtttttcaaaagggtcaatttgtaaaaaaaaagaatggcaaaaactgccatgtcggacgaaaccgcctcctaaaccacggaaggagatcatttacaccggttttcaaagatggaacagacgttatacccggttttgttttgtagttgagggatagattcgaagcaagagttgagggtggtaaaataaacttattcctgctaggctagggaaaggcgcattatgctggacttgggactgggccaccgcccaccgcagtccaataattacggcgttaaagacctagacgaaggagtggtggaaaggaagcagcctcccagattcccacccccccaccatctctccgtaaagctgacggctttgggaaggcgatgatccggcgattcctgtatatggtcgacatcttcgacaaatcacacggccctatctcccgcaggctacgccgcatcaacccatcacatctcttctaccccaatgatgcactgcccgtgccccaatcgtcgtcgtcggcgacggtggtggaggacgcccccctgcctccaatagacatgaccttctgcgggtcgactgagttcatgcgtaggagcgacgacaagatcgtcagcgtcgacaggactactcgccgcgccatcctctacgaccccgccgagcacaccgtccgcgtcttgccctccatggtggagtacaagttctggaccaagtcgttcgccgtcggcgacgatctctacgtcatggagacgataccgctgcctgacaaggtggatctcggccgcgatgcacggccgggccgttctttcgaggcgctcatccaccgtgaaccacgccccgtcgatggcgacaggatagaggacgagtgctactggcgaccactgccgccgcctccgtacgtgcacgccgccggcataagaaccgacggccagatctgcgggtacgcggtggtcggcgagtcccacatcttggtgtccacccacagctacggcgcctactccttcgacacggcgagcgccgcttggagcaaggtcggcgactgggcgctgcccttctgcggccgcgccgagttcgtccccgagcacggcctctggctcggcctctccgtcgcggacgacggcgtcctcggcgcgtgggacctgtcctccaccatccaccaccagcagccgccgccggtggcccaccacgggtgtaagggctttgcggtgccggaggtgccatacgcctcacacgtcgtgcaccttggcgccggcaaactgtgcgttgctaagctgttcatggtcgctcaccaccgggagacctgcagccattcttgttgcgactttgacagtgataaaaggtacttcgccattctcaccggtgtggaggtggtgcgctgcaatggcgacaaggttgacatcatcaagcacaagtcctgccgttatagctttggtgaacactacatccccatttatctactctaactagtagagtactcctacctactgttttaataaacctttatttggttaatcctgctgtttttcttgtaaactcttttattgtacatgcatgatttgaaggaatcaattaattatattttgaagcacctgaaataaaaatataacatttctaacctgaataatcatcacaacatagtgttcaaagtggcagaacctatggtactggagacaacatatgacagtaaccataacagataagcatgagaccaacaagtcagcttcctttttgttaatcaggaatggtactttaggatctgcttatgtggtttagctcgtgtgtctctataattttcattcctttaacagtccgcataagcgcatacagcattgaatcatctcaggcaacgagaataacctattgcttcaatcatcattgcataaatgtgcattacagtgaataacccagattgctgcaaataaaactatgcactttttatctgttaacatagcctacactgttaaaccccctcctcatgtaaaaatcagttggaaataaaataaaaatataatctctggtgaatcgttttatgctctgttgattatggcagtccaaaaacatgttgtcaccattgtccatgtgcttaacttgaagaaagtctactggtatttgtctggctcaaatcctttatccagtaatcttttctttttgatgatagttataaagttagtcaccgttgtcatactcgatacgtttggcaaacacaatggatttgataacaatcaactctttgaaggtttgttcttcagctttattctaacttaggcttaactgaacatcctacttcagagtctttttaatgtgcttggagtattatatatgagatccgttgttcacttctaatctaatggtcaatgataaaaggtaccaattaggagtagttaaaatgtgggccaggtattaatctaaaattttagtggaaggttagataagtaatttgatcctaatatcaaaacacaatttacctctttaaggccggcgcctcaggccgcctctcgtgctgtacacgtaggatagctacagtacgcagggtggaaattttgcaaaaaattcctttgcttttgtataatttgatcaaggtccctcccgaacagtttctctgaggtggtattttacgtgtagggcctgcataaagccggatatttcatgcaaaggagggaaaaatcgcgaattagggctgcgatctaaaatggctctaaaatgtggaagaggaggggctttttcgcaaaaatacgcgcactaatccactccccccccccccccctctcaaaccctagccgtcactccccgcattccctctcccctctcgtctcaccctctcctccctctccctctcccgccgccgccgccgagcgccacatccgtctccccctcacgctgccgcctccacctccgccgccgtcgtgtcgccgtctccgcctaccctcctcctcgtcgtctcaccctctcgcgccgccgccgcctccacctccgccgccgtcgtgttgctgtctcctcgcccctccgtgtccgcctcttcctcgcgccgtcgcccgagcgcaaccgtctccgcctccgccactgccgtcgctgtcgccgagtgctgccacttccgccttcgcctcgctccgcccctacctagcaccgcgccgcagctgccgccgttgccgagcaccgccggagcgccgtcctccatttctgtcgctatcgccgagcgccaccgatgcatccttcgccgccatggctgacgactgctgcgccaagttctcctcgagcagctcgccgcagttgtcgatgaggaagtggcgtcgaatccggcaacatctgacctgctgctgcgcctgcgccactgtcaacaatcgatttcacctgccatgaaaaaacaaaagaaaggtcagttattccggttccctgccttattcgagaggaaaaggaagtattggtgtaggcgtttagctacaaatatggtcatgcagcggcgagagcagagctgaggcatcaggcgtggtgcgcgtcgcttgatggtgcttgccggcactgtcagcaaacctggcaagaggaccactcgatgatcttgtgaacatttacagacggcttttgcatcattaagggaacttgttgcatcatggatgactaggatatcagaagagtgcaagttgtggacttcttctgctctatccaaacaaggaagacttcagatatcctaatatgcatattaatggaatttttagaaataaaattttcagctcctttaactttctgcttcaaatgcatatttcccattccaatgctcctaatggattgtattttgtctcaagcagttgttttagtaaaaaaattgtatgtaatacatgagatagcctgggacagtaatagctcaagaaacaaaactctctttgagcacaaagagaaaagtcctttcaagccgtgagaaacttttgggtacctttttggcctcctatcatatgagctcctttttcttctcccctgtaaatttgtcaagttctacctcactgtaagagagaggagatagagagagatgtactaactgatgaactgatcaatacaagtcctaactgatgaactgtacaaattatatgtgttgcgggagcgagaagttgtgcacagctgagttgggatcagatcatctaatgcttactggagttcaatgtggttattttctatccacgcgatctcaagactttgcttaggggctattacaaacacgagctaggtgggcgacggacctcatattatgacatcgaagtcacttctgactgaggtgtgttttgtcaaccttcagtactcatgtttcatatttaaggtcaatgtgtaatgtcttttacatggctgtttatatctcaggcaagatagtttttgcacttgtaccagcatttgccaccacttattcaattcataagatcccactagccatagtggcaatctcaaaaccactatacatcagtgaatttccatcttatatagctagcttgctggaagatgaggaggtgaacaaatccttcccagatctgtacagttggttctgaccctgagccgcttctagacactacggcgggagttctgcttccattgcctccagattcctgcaactccatatacggcacatattctgttggtgtattccaggtataagtttgttctttgctctggcctagatttgcagttgtttcagcttctgccttatcttagttattcgttttctttagtgtgattcaattctgtagctaccattcctaaagtttgcgttggctccccttttttttcaattggtacatgcagcaggctaggatatcaaggaaacaaggggttgatgaggtgatggacaacagtgcaggatcaacaatgagaacaggatggagcggagagatggatcagtagttcctccaatctacaagtgcatactataccgaacgccacacatgatctccgtttaggatcctcagtagtggtatgtctaacatgatgtggtgatctttgtggaacaggcataggtttgtgtcttaggtgaaaaatagcacatatattattctgatgagaatatatttgttggtgctattttcagcaacacctatgcatttggtggattaatgtttgccaagcagttctattcacctaaaagtcttgatgataccaaaagttggttaatggttatagtagtgtacatggacaacgttgcatagattatcttatctgtttttgcaaggggatattcataccaaattttcttatggatacttctctaacaagaaaaatagtgaattaatttgccctgacaatgatttatctggtatttcctgccatgcgtgtagctgtatatgcggttactctcaggaaaattgtctttgtttgggatgaaaatatgctatactccagatctaaggtgagaagagtagtcacattttttattctctgatttctcaagcagtatatttcactggcagaactagatcccaatacaatttcagtcctattcttttcttcctagactcagctcatttatatgttacttggaacagatatcagtacaatatcaatattttttcatttgattttcgttgtcccgtcaatgtttatatgttagcttatgggacaagcatatatatgaacaggtttaataaagcctcataaaggaaagttgcttcatgattttaagtcccaatggtatttttggggaaacgcttcacatcgagcgtccggagtgaaacaaaatatcgaaccaaaatgtctggtggggcctactattgatttaacccattctttacctccctcctctaatcctgcaaccaactaaccctaatcccatttcctcctcgatccaaatgccctccgtcggcgactatccatctgcccaaccatgttcttccctgacgcggacgacgagtctgacgacagcgacttcatcgacgccctcatcaacccctccgatcccaccttccctaacctgacccccgtcgccgctgccgtcgccatggcttccgctgtgggggggcgggagtgggaggggtcggctcctcccgcagcggtggcggcgagaggcggcgcggctccctccttctatgacgacgaccaggcccgcgtctcctcgggcccctccctctccatctctgtagcgggcacgccttggtcgcgcaaccttcctccctcgccgatccgctcggccagccggagtagaaaaagacagaggtgggtttcgttgggaattttagtgaagttgcagattatttgcatttttgttgcactttgttctatgaagttgtttcgttccgttttgattcattattgcatacattgatttttggtgttgcaatcagtatgttcaattattgattttgttgaaacaaattttgctcaagcaccgaaacatttttttctctgctagtggaactttggactcattgttgcatgcatcgatttttggtgttgcaatcaatatgttgatttagttgaaacaattttgctaaacactgaaacattgttctctgctagtgaaacatttggaacttttttattgaaacaatttttaacaagagatgaaacatgtgaaacatttctcaacaacatggtgcaacaccgtccgatgattttcacaggatcggacgtccgatccgtagcagccttcgtatttttgcaatgcaacagtgaaatcacctttccctgtcctaccaagcgaactcccttcctgatcctcatcaaaaattcgtttctttcctttcttttttgttcagaattgaacaaagaatttggggaagaaaacatcttcccccacttatcatgatagcctgctccagtccccttacgaaactttcgttattgggttgttattgggttagccatacacttcacatgtttctagtgattcacatgacatcatcaaatgatacaagtcttggataagaatctacaacgcactagaacgcccttgttgacgattctttactgagacagcatctagggctcctcgaataatgtgatctcacaccgggtaaatccttaacccttcctcctttggtagaacatatgcgcctttggttgattaatacataagctagtcatggttatatccgagctagttgtgttctcatcatcctccccttcttgattggaaaccgtcctcggtttcaccttgtcatggagcgtattgaatttatctttatctatcacaacatccggtgaggaacatttattgatggccatatggttggatcctgaaatctttatagtcgaaaaccacaacattccccttcttgcaaaccaacatgtaactcatttaaaccactagaggaactagatagagaattacttatacgcatgtgttcctctagacaatacatttcatcatgaaaaggaggtatagttaaattcgaacaaatatatactcgatgcacattacattctcaagtatttaaagaagatagaaatttatgctcttcattcttgctagcaatgtgaataacatgtttaaactcaacacatggcaattcaacaacataactaacatgtttattcactagttgtggcatggatataagtgaagcatcgcacaactcttctttatcacaagaaacattaagcaacttgttttgtgacaaaggtatttcaacaattgtttccactatgggttgctctaatgtagcgcaagtagtggacatagttggcacatcataaatatgcataccttgattagttgtagcaccatcaccattacctttattctcatcttcataaattataggtgcttggccaattgaacattcttcaagcatgcatggagctatggataggtctttttgctcttcgtctttcttctcttcctcctcatcatcttcaacatcggaggtgctgatgtagccatcttccgtagcagcgtatgcccgttgactagggcaaaccttctgcacatggtcaaatccatggcagcggtggcactgaatcctgggcgtgcgtcccgttgaagcaacagatgaggcactcttggtggatacctgtgaagaacctttacctgaatctacaggtcgtgaggaaggtggttttggcgctgcagaaactccatacgcaactggtcacttgctcgttggtgggggcgcccagaaataggtgggcttgggcagccccggagatggcttcgcccgcggcgtgtacgtgcttgccttgttcttgacctgttgatcacgcccctgcaattccttctctccaaacatagcaaactgaaacaactggttcacagtgttaaattccatataatcaactatgtcctgaatatcgcgcctcaatctcgagtaaaaacgacaaatagaatcttcggttccctccactatgctacatcgcatcaatcccttttgtagctcgccatagtaatcatgtacagatttatcctcttgttctaaacacataagtttcttgcttaaatctctaagataagatggaggaacaaatctatcacgcatagctaccttaagttctttccaagtagtaggtaaagctctcccacatctaacccagtccaccaaatataagaaaaatctttaaacttactagtagcttgtcgaactctatgctgctcaggcacaaggtgggcactaaacttttgctctactgtcatctcccaatcaaagtatttctcagcatcataataacccaaaacagatggtattttaaacttaaccttagaataaggatcatcaggcacgcgattattgttaccttgttggtatcgttgattttgagcaccactcatacttgtcattgcaaacacaaaaacaacagcaaacagtgaaggttatccctaataatctgctacgcggtgtagtggtgcctctcaacaactcagccaaatggagcaccttaccaagctcttacaagtgtcttaccagcactgctaaggacggtacaaccggtggctggttcgtgacaccttgaaggacgtgatgtggcgattgcaaggatcaaagtggtgctgaccagaagtatatatgtgaagcttaggaggcacaatatatagtagcaaaggaacgcaattgtgctaatcagaaaatgcaaagttgaataataattcaaagtactagtcaatgtgctggcctagcttagactcaactctagctcaaggaagcacccgacaacactaaggactagatatgaatcaatgcacaactctacactctgaaaacatactcaaaggatgaatgatttttttttctttcttggtgcggctttttttaagcacatttctgccttttttttctttttctaaggtgcagttttttctttccttttctttgcacctttctgccttttctttcttttttttattttttactatttttttcaacaagaactgaccattgacctcaaacagggtctcaaatgtaaatatgaatattacaggtacttaaatgctaagtgcaaaactaaaattagatcacctcaaaaatggaatgctcatgtcatgtaggttccgtttttataaaaatatctcaaatcggcaaccactaaaatacccaacaatgtgatgtaatgccctagaaaaaaagtagaataccgtagaggatatattggaagtccctaaggttttggtgtttgaaattagaagaaaaacaatagttatacgctagctgggctagctttcggccagcccaaggcccaggtgccccctccacaccccctcaaaaccctagaagatcccctcacctccccctagccgtcatttggtaccctgggcgcccacctccccctaggggtgggcagaaaaagaccgaaccgaactaaccgagaccgagaccgaaaaattcggtcacaaattcggtcatcagttgtaactaaccgaattttatacagtcttttcggtcatctcgctcggttaaccgaaataaccgaactggccgaatcactgtaaaggcccaataccagcccaatagcccattagctagagaaaaccctaaccttccttcccacatcacacgatccttcccagtccccacaaccccacatgcgcgtgcagatgcaccgcctcttactcgctctttctcctcctcctccccgcctcctctccgctttctcctcctcgcaccgctcctctccgccttcttctcgcgtcgcgccgccgccttcctcgcaccgtgcctctccgtcttctcctcgcgccgtgccgccttctcctcctcgcgccatgtcgccaccctctacccacacatctgcgcgcccacgacctgactcctgaggcctcgatgacggaaggctaatgggagacacaagatggatgggatctggaccgtggagtggttgagatcgacgggatcaatggctggattgatttgcttgatttgattttttttccatgaatcatgctctacttgctacttgttgtggcatcatcaaattttagtccttcatcccagttgctttttcattcatcatgtacagagttctttttttgcaattattttttgggctgagttcggtctttgaccgagaccaaaccgaattaaccgaagaccgaaatactctatcttgagttttcttgaagaccgatcagtcttgtgatcgtaaagaccgaatttttcaaaagactgaagaacctaaccgaaattttcggttagaccgaatgcccacccctacctccccctctggtcgacctcccccatgcctgccctactgcagacctgggaagaagaagaagggaaggagaagaaagggaaagaaggaagcggagggaatcgaggtgaagatggaaatgaagggtttgattaccgctgcccatggaggctttccccctgttttggttttctattagggtttagatcaagtgttggaagcgagtaagtttgggatccaccgatttattcctcagccaggttttcgctgatctgccccctgcgcagttctgttttggatgccttttcggccaagataataggatttccttcgaaaagtctctatacaaaagttgtaaataacgtgtagatctatcttctgaccaaatggcatgattttatatcaagtggtttaggaggtatcaatttctgaagttggctgtctgaatgtcgatgcatttatctgtagtcgaggttcagagggattttagaggatcttaatgatggaatccgagaatcttgtatttacagaagttgtagcatatgttgtgatctacctcctacataaaaattgttagcttttatcttgtagtttgttgtcagtgctcttttgaatggttgttgcacagttttctgggcagatgcacttttctgttttgtgccatgttttaggccagctaaatggaagaattcagttttgttatctaaatgaaagttataactcttgttctgtagatgtcagaaatgatatattttgctatgttatgtgatgtagaattggaggtatcgagttgttaatctatgctgcttttataggaagattatcggtaattttctttatgttgtttggggtgggttcccagcgtagaaagtgaatgtgtgattcttgaatgattatatgtgtgttgtttgaggctgagtcggtgtttattcaggtggtgccacttcggaacgcaactagagttcatctcgccatcggagaaggcaagtaacgtagcggtggtttgctataactttgacttgttatttgattttacctccacgttgaaattatatatcatcaaccaagattattatatgttatacataggatttacctatatgaatcatacttattgattccttcttgtagcataaatcaaaccttcaccctgaacacaagaaaacactttcggcgccaaatagcctcttgggctaaaccattataccaactaagcttgggcaaagctcaaccttagcaacgggaactggctttgtcatcatatcagcaggattatcatgagtgtttatcttgcatacctttagcttaccttgtgcgactacatcacgaccataatggtacttgatatcagtgtgttttgtcctctgatggaacatctgatctttagtgaggtattgttgatgcaaaaaacacacgctggcctggaagatctgcttagctccagtgcaggtccaaaggttggtaagatgcaggcgtgctagtcagtttgatcctgcaactgacaagatatgaaaatagcagatcaatgaaccgatcggctgacaagccgatggagcaattccagccgatgccgataccagccgatagcgatagggttttgagctatcggttgtatgtccaatgtagattctgatacttgatgtgaataacaatataaaggcaatcagctaataatgataaataacaataatataatccagtagaaaccaatcggctaacaatatgatataatagaacaagtattgatctgaaggttaaagcatacatcggctggaggtccgatgtcataaaatccacaagattagatagatcaatgaaacctttgttgtcattggctaaatccgacttatatgtatatccaatccttataagccgatgcaacgtctagataccttatcagttagcaccccaataaaacattagcatgaacctatcggcttagcaagatttatattatcaacaacaatctagtacgtcgaacctaaccgatgcagcacgagattgtatatgataatctaatactcgatgagccgatagatctgtctaatgtgatggatataacaaatctatttagaacagcattataattgtagagatatattggctaagacagaagatcggacctaaccgagatagtcccaactaaaccaatgcgtctctaaacgcaatgcaactagagatagaattaagatatcaggtaggcaaatatatcaaccgaaccagagcgcgatccaagagatcgaagcgatgcagccttgaacaacaccaatgtagccgacagattcaccagggccggcggaacgtaggacttaccccttcgccggagatcgaactgaaccgatgcagccccacgtcaggtgccaaattccgtcggttgataagtaaaaacctcaggaaagagggtggcgacgcgccgagagtagttttattgattgtgatattgattacaatgaccccgggtgtacatatttatacccatgggtagatactagtccttgtaggactagaaagaaactttcctaaaaataaaaggaaaacataaagtccttaccggacactaaacacactttcctaaaaataaaaggaaactaaaccctgcctaattaatagataaactgccatgttgtatccttcttgaacttggactcttctagataagcttcctttaattgatccgactccaccaagaacacaactgttggactcttctagataagcttcctttaattgatccgactccaccaagaacacaactgctggtgacttgacaactcacatcgaccgattccgagactctgaagccgatattgactctaggccgatgatgattttgggcttacctaattttggcgttaacaggtatatggcactttgattgtcacaaaataggttaatgcaagaatcaactccacaaatctcagcaaacaatcctttcagccaaactgattccttacatgcttcagcaatagccatgtatcctgcttcagtggtagactgggcaacaacaggctgcaatgttgccttccaacttacagcacaactaccaatagtaaacacataacctatgagtgaccttcgcttatctaaatcagcaataaaatctgaatccacatagccaataagtcccttagcagccctgccaaatttcaaacaagcatatgttgtgcctcaaaggtatcagaaaatccactgaacagccttccaatgttctttgacaggattagccatgtatctactgaccaaactcatagcatgagataaatccggatgagagcaaaccatggcatacatcaaagaaccaacagcacaggaatatggaacccttgacatgaattcaacctcctcatcagtactagcacattgtaaagctgataatttaaaatgaggtgcaatctaagtactaacagactttgcatcatgcatgttgaaatgatgaagaaccttcttaatgtaactttgctgactaagaaaaaacaaaccagaatttcggtctctagtaatttccataccggcgacaggcctccacttcgcttatgctagagtgggttggattatgtttcttgggttccctttggattttcgtacccaaagctatgtcagccgtgttattagtctttttgggaggcttgattattggcagtagatggatgtagtcccgggaagagttatgctgcgagctttttatgatgatgttgatatggttcctagaacaatagtgatcaagcaaatacccaatcagggtggtcagggggagtcttggactttctctgtttttgtcctcaacaatgattttgccggcattcaggctccggatgaagatttaccaccaatgggtgccctagatcctgatcttgaaaataatcatagcaatgggccggttcaggaggagcatcttgataatcatgctggtggttggggagattgggagcagcaaggggagaatcaggatcagcatgtgataggggattctggagtgagtcagcagaatcagaatcagaatcagaattcagattctaatggtaatatgcagatagtgccttttgtccctttggttgatcctgctttggaggttgtgttcactgttgctgaagaaggccctttatattttatttctgatgaaacacaaggaaggattcaagaatttttcctcaggaaggagcttctggaaaagttggttaatagtttatcttcctcttttattccgggtttggtgaccccctctgctccatttagtcagttggtactcccaaaaaggaagttgagtaaagatatctcaatacccaggtgacgccaaccctaaacccaaaaaaaaaagggtgcaatcttgtttctcttttccctccatgacaaagcacgcatgaaagatcatcattgtccttagcacagtgccggcgatctagcatatcttgagtattaaacctgtcattgagcaaaagtcaagcaaaaaccttgatcttcatgacacatctggtttttcacaaccagataaaagatcttggaggatggagagattgaaaattgagtttataaactctcctagcagaatacaattctgctctatcttaccgttgcttatttaacctatttgaccatatatatatacctaattaaaaaatacgtaaggtttccgctcccccccttcgtccgtcaaccccccccccccaccgcgactccccatccgttttcgtctctctctctcccccctcccggtgtcccgatctccacacgcttcccctacccgcggccttcttctccctagcgcccctcctctcccgcctccctccctccctcacggcaccccacatctatcccttgcggcacgctctccccctctcccgtgacatctcttcttcttggcatccctcctctcccctgcgttcctaccctcttgtgcgttcaagaaaaacggaacctcctcattcgggaacacgttttgacgtactcatccggccatgttcaccactagaactccccgttgccgtttctctctctatcggtaccatgttgttgttagccacgttcccattattctggttttcttcgttgccaaccaccacaatctatgacgagccacatcgtgggacacgtccgaccaccttactcacccccgtttggtcgctggagcaccgttgcccatcttccctcctcttctatttgttgtgttggctagggaagacaatgaacaatattattcgttttttcttcatcttttgttcttcctgcgcatttaaggaaaacggaatcctctcatccggaaacatgttttgatgcactcatctggtcgtgttcatcaacaaagctcgttgttgttgtttctctctatcaggactacgtcgttgcccgacctgttcatgttgttctggttttctttattgccaacgcccaccatttaacgtcgttgtttttatctctgattgcttcgattttgactagaaaacggaaagaggagatcgagtggatcaaaagctatcaacaaattttggagatcgagaaagattagacctttggagatcgagaaagattagaccggatttgatgggggaggattggctctgtcatcgtatggtcacgtgaccgtgcgagctccaccggatttgatggggaggatcggaaaaggtcgaggacaattgggggcaatctggaaaaggtcgaggacaatggtggaattcaggcagaggtagaggacgatggtggaacaatgaaagaggaaaaggaagagaaaataaacctgaccaaaccaaattttgtcaaacacatggaccaggaggtcattccacagaagaatgttacagtaagttttgtcatatacatggtccgggaggccattccacagaagaatgcaggcaaatgactcacttgttggaaaaacacgtaaatcgatatgagaacaagtatgaaggagctcgtgatcaacgaggacaaaacgccatagaagcaccgcaagttatgaagatagaggcaattgaagaagtgccaaagagagtgataaatgccataactgggggctcttcattaggagttgagtcaaaaaggcaaagaaaagcatatgtcagacaggtaaatcatgtcgggacaagctatcagtcaaatccaccagtatactcaaaaacggtaatttcctttgggcctgaagatgcagaaggaatacttttccctcatcaagatcctttagtggtctcagtggaaatagcacaatgcgaagtgcaaagagtgttaatcgatggaggaagttcagcggatgtgctgttttatgatgctttcaagaaaatgcaaatacgagaagataggttaacaaacgcaggagtacctttacaaggttttggtggacaacaagtacatgcaattggaaaaatatctttacaagtggtctttggaaaaggcactaatgtgagaaaagaagagatactatttgatgtggtcgatatgccatatcagtacaatgcaattcttggaaggtcaacaatcaatatttttgaggccataatacaccacaactacatatgtatgaagctcccaggaccaaggggagtaataacggtccgaggagaacagcttgcagcaagaaagtatgagcttcaaggaacaccaagtgtgaaaggagtacatgtggttgaccaaaaacagggagaatacataaaaatacaaaagccaattcctgaagggaaaacaaagaaagtacagttggatgaacatgaccctggaaagttcattctgataggagaaaacttggaaaaacatgttgaggaagaaatcttaaaggtagtaaaagaaaacatggctgtatttgcatggtcaccagatgagttgcagggagttgatagaagtctaattgagcacaacctagcgattaagtcaggatacaagcccaaaaaacaaaaattgagaagaatgtctacagacagacaacaagctgcaaaaattgaacttgaaaagttgttgaaggcgaaagtcataagagaagtgatgcacccagaatggctggcaaatccagtgttagtaaagaaggcaaatggcaagtggagaatgtgcattgactttacagacctcaacaaggcatgcccaaaagatgattttcctttgccacggatagaccagttggtagatgccacagctggatgcgaactaatgagtttcttagacgcatactctggctatcaccaagtttttatggtgaaggaggatgaggaaaagacatcatttataacaccatttggaacttattgttttatcagaatgccatttggtttgaagaatgtaggagcgacttttgccaggctgataggaaaagttttggctaagcagttaggacggaatgtcgaggcatacgtagatgacattgtggtaaagagtaaacaagcatttacccatggcaaagatttgcaagaaatatttgaaaacctgagaaaatgctcagttaagcttaatccagaaaagtgtgtttttggcgttagagcaggaaagttacttggtttcttggtgtccaaaagaggaatagaggcaaatcctgacaaaatcgcagcaatccatcaaatggagccgccaaaaaacacaagagaagtgcagaggttgacaggccgaatggcatctttgagtagatttctatctaaatcagcagaaaagggattacccttcttcaagactttgaggggggcaaacaccttcgagtggactgctgaatgccaacaagctttcgatgacttgaagaaatacttgcatgaaatgccaacattagcaagtccgccaaaaggtcaacctctgttaatgtatgtggcagcaactccagcgacagttagcgcagttttggtacaagaagaagaaaataggcaagtgccggtatactttgtctcagaagcattacaaggaccaaaaacacgatactcagaagtagaaaagttgatttatgcaattgtgatggcttcaagaaagttgaggcattattttctgtcgcatgacataacaataccatcggcatacccgataggagaagtgttaacaaacaaggaagtcgcggggagaatagcaaaatgggcaatggaactcttaccttttgacctgaaatacatattaagaacagccataaagtcacaagtactagcagattttgtggcagaatggactcccaatgaggtagaacaacaggaagaagtcgaaaaaccatggatagtattctccgatggagcatgcaatgccgccggagcaggagccgctgcaattgtgaaaacaccaatgaagcaaacgttgaagtattctgttcaattagcttttccttcaacaaacaacacagcagagtatgaaggcgttttattggctatgagaaaggcaagagcgctaggggctcggcggttaatagtcaaaactgactcaaagttggtagcaggtcacttttccaaatcctttgaagcaaaggaggaaactatggctaaatatctggaagaagcaaggctgaatgagaaacatttcttgggaataacggtaaaagccataacaagggaagaaaatggagaagctgatgagctagctaaggcagccgcaacaggtcaaccattggaaaattcatttttcgatataatcacccagccaagttacgaaaagaaagaagtagcatgcatacagagagaaggagattggagagaaccgatcttgaaataccttgtcagtgcacaacttccagaaaaggaagaagaagcaaagagaatacaactaacgtccaaaaaatacaaggtggtagagggacagttgtataaaagtggagttactgctcctttgttaaagtgtgtaacaagggaagatggcatgaagatggtggtagaaatacatgaaggcttgtgtggagctcatcaagcaccacggtcagtggcttcaaaagtcataagacaaggaatctattggccaacaattatgaaagatacagagaaatacatcaagacgtgcaaagcatgtcagaagttcggtccaatgacaaaagcaccacccaaagaactgcaaccaatcccgccagtctggcctttttacagatggggaatagatatagtaggtcctcttccaagagcgaagggagatttgcgctttgtcattgttgcaattgaatacttttcaagatggattgaggcagaagcagtggcaagaataacttctgcagcagtacaaaagtttgtttggaagaacataatatgtcgatttggaatcccaaagcaaatagtatgtgacaatggaaagaaattcgaatctggaaaatttcaagacatgtgtaaaggccttaatttgcaaatcaactttgcctctgtaggccatcctcagacaaatggagctgtggaaagggcaaatggtaaaatcatggaagctatcaagaagaggttagaaggatcagcaaaaggaaaatggccggaggatttgctatcagtgctttggacactaagaactacggtagtaaggtcgactggcatgacccctttcagattggtttatggcgatgaagcaatgactccaagcgaagtaggggcacattctccaagaatgatatttgaccaaaaagatgaagaaggaagagagataactcttgaaatgctagatgaaataagggttgaagctttggagaagatggcatcatacacagaaggaacaaagagctattagaaccaaaaagtaaagacaaggccgattgaagaaggagatttagtcttgaagaaagtgctcaatgaggtagctgttggaaaactcgagtcaaagtgggaaggaccattcatagtcaaaaagaagacagaaacaggagcattcaagttagcatatcttgatggtgatgagttaaagcatacttggaatgctatttctttaaagaaattttatgcctaaaaaaaagaaaaaaaagagagagaaagagaaaaaggagaacacgggagctcgagtttgtagtatactcactcagatgtaaatacgaatgatatccaagttaatgtatataaacaggacgtagggtttttatccataatggaggcccgaacctgtataaaaaacatgcctctgtgtatgattgcaatagaactccgcacgctcggagtcgactaacaaagtcgacaaaatagaactccgcacgctcggagtcaaatactctcgactaacaaagtcgacaaaatagaactccgcacgctcggagtcaaatactctcgactagcaaagtcgacaaaatagaactccgcacgctcggagtcaaatacattcgactaacaaagtcgacaaaatagaactccgcacgctcggagtcaaatactctcgactagcaaagtcgacaaaatagaactccgcacgctcggagtcaaatacattcgactaacaaagtcgacaaaatagaagtccgcgcgctcggagtcaaatactctcgactagcaaagtcgataaatttgaactccgcacgctccgagtcaaatacaccttgattactcaatcaaagaaaactcataacttcgcacggttcggaggaagaatacagctcgattacttaaaaagcggaaaatccgcgtgacgaggtaaaacacgtttcgacctcatcactccttcgaaaggtgaggaggacggcggttttcgaactattttgccttagtcctaaaaccagctcaggaatgctcgaactctattctcgttcgagctcaaaaagcggaaaatccgcgtgacgaggtaaaacacgttccgacctcgtcactccttcgaaaggtgaggaggatggcggttttcgaactattttgccttagtcctaaaaccagctcaggaatgctcgaactctattctcgttcgagctcaaaaagcggaaaatccgcatgacgaggtaaaatacgtttcgacctcatcactccttcgaaaggtgaggaggacggcggttttcgaactattttgccttagtccaaaaaaccaactaaagaatgctcgaactctattttcccctcgctcgagctcaaaagacggaaaatgcacgtgacgagataaagtacgtttcgatttcgtaacttcttccaaagataaggaggacgtagtttttttttcgctttactccgaagacagacctaagggtgcttgaacaattgaaataaagagcatttataaagaaaagaagaaaggaagggtttatttgatgttaagaaggtataacaagttacatacaaactctacaaagaagagagaaaagagtcgggataaacaatgttgagaggagaaggcattactgtatatggaactattgaataacgccttttccatattctacgttggcgttcggatggttggaagttttgccaaaaggctttactagcaagattattgttcgaacgccgttccctaaactcaagtacaaagtcacgtaaactgtcatgtcgatggcttcgttgccatcggaaaaacttaaaagcaaatatacaagtattatcataataggcttcgagttcgtcatcggagatggcggtcctgctagaagaaagctttgcagggtctcgaaatgctaagtgcttcacatttcgagtaggcaaagtgttgttgcgtcgaatcacaagttttcgattcgagttaacctgcagccccccaaagaaagggaatttccgtgaaaagcatgcaataagagaaaagcattatagtcagctacactataaatttttacaataaaggctctcaaccataacggttttgaagcagcaaaatagcattgttttcgaacatacgaagcatccttaactattcttttcacgaacgtcacacctgtgcgctcgacctcggagtactactgtctttatcttgttggctcgaactggccggctgtgactttgatcttgaggcaagagatgctcggagagacctcagggtatcttcatatcctttcttcttccagtaaagcacttggaaagcctttacgacgggttgagctgcatctcgaagctgtgcaaatttggcctcatcattaagcataccttgtatatcagctttaagggtggtaaagtgttcacacccatttgaaagcagacaggccgaaaggctctccacagcagttttcgagcagcgagatgcaaagggagtaacgctatcttttagcccaatggaaaattcctcgaaccattttcccacagctgctaaagtattttcttccgatagcaagctgatgtcagcccctagacttcgcaacgcgattcgaacggtctcgcaacttttcagaagaagttggcggcaactttcgttctcgagctctaaagcagatatcttctcgctttgatttttgcaggcgagttcgagttctttattcttcttctccaagacctcaacttgctccttcatcttgtcttctgattcagcgcgttgtcgtgcgacgtcttgatactcgatgatttttcgctcgaatgctttttcacgagcgagtaatttcttcttttcctcagtaagcaacttcttttcctcggaaagctctttcttttcgccgcttaacttgcgcacgagatcggtggtaattttcttctcgtcggccattcgatcaagtttgcagcgaagataatcccgatccttttcgagtttagcgatgcgatcaagtgatttcttccgtcgcgtgcaaatagctcgaagagctttccgagcaacaccacgttgaagacgagcaaggctcgcagtctgcgcatcagaaaataggttttaagtcaaaaaaaaatataatataatataataaaaataaataaataataaaaaaaataaaaataaaaatacctgtgcagcagatacatcaagtgctgcccaagaggacataagatcattttcttccaaaaactccttttcaagatcaggagtaatcagaacattctcgagttcatcaccaatcgaactcagggggtggcgatactttaggtcattcaaacacaagtttgggccatgatggctactttccccgagttcattgaaattaggaagacccataagccaatgtccatcttttgcacatcgttcgctaaaaccaccaagaacgttttgtatcagctctggggaaggggttgcgatgaacggcggtgacggaggtggagttgggttcgaactacctgtagttcgaacacctccatcagcagcactcttccctgcttcggacttttcggccgcattgacgggcgtttttgccttttttgcaaccaagtctctatcagctcgaagagagtttgttgtctcaacagtatcacccacttgggtcgaacaatcttcatcgacaaccgtgttggctggggcaacaacatacagtgaagctacttcttttgccgaaagggcaaaactagcatcagcttgaattggggtgacatggatggcagaaagatcaatacggatatcatcttcatccaactcttcatcactgtcaataacaaactgcactcgtttagaactcggttcaggcggaggactgctggcagttttcttccttttcaaatcagctaaaacagtaggaggaggaactgttttgctatcatcagattcagacgagtcgctcgagttgtcgctcgaactgttactcgagtcgctatcatcactcgagtcgttctcttcttcatcagctccttcctcttcttcttcttcttcagcattttcttcaccaatttcttcgtcaacatcttccacttcaacatcatcatcatcatcagaagaagaaggcttcacagatttctttttctttagtttggggacaatttcaggataaacccggacagggatatcggagcctagagaggcaaagacccgattttgccttttcccgttttgaagtgtcaaaaatttcaaatgctcatccttggtataagggccaagaaatttccgaactgggcggaccatatcctctggaatcacaactacaaggaagaagataacaaagggagaaaataaatcttcttaactaaatcactttttcaagaaaaacaaggttcgcaaaaaaaaatcaagttcgaaaaggaaacttacgatcagacgaaaccacaaatggaggaagactggaagggcaatcttctgggatttctccaagagtgatatcccagccgctcgaaagaggtctaattttgagaagaacaaactcttccaccaggtctcggcagctaaagttcgaaacaagttcttcgattcgaggttgtatggcagtgaactccggcgacaaagagactgatggctcggagacagcttttggtttcttcccagagaacgaaaaaggacaatccttatcattcagcaggctaacagggatttgatgataaaaccacttcgactgccacttgttcccccattttgctcgaatagcagacatagctggccatggacttccgcgcttcggatgaggagcaaagtttacacacccaaacttcgagttctgtttggtgtagtgccgagtacaatggaagtatgcaaagtcttcagcttggggggtctcaccgcagcttcgaaccatccattcgaaaagcccaattcgaactaaagcattcggagtcaattgaggaaactcaagtttgaacaatttcaggacctcgaccaaaaaagtgctgcacgggaatttaaacccggcgtagaagaaatcctcaaacacaagagtgtatcccagcttgggagaaggccttgattctcccactggtcaaattacaacgtttcgaccagatatccaaccaacatcaacaagatcgtttaagtttttgtccttaatcgaagaggcaccaataccacaagaagtattttcgtggttttttgatttcttggacttcgacttttccgcagttttcttgtttttccccatgttgtgtagtgagaaaggaagaaatcaagcaaagcaccaaaactcgaatggaagaaggaagaaagagatttagttcgagtcttttgtgatttcgagttgatggcagaaaaaacgagtggtggcgtaggtcgcgtgatagcgacccctcctggccttatatagcgcagggtggtaagggtcgcgggtttacgagcggacacgaaacccgaagcgacgcgaccccttaagcgcaccaatgaaataccggcacgtggcataaaaaacatttaaaaaataataaataaataaataaaaatgaaaaataataagaataaaaataaaaataatgaatagtaaacgtggcatatatgcatatttgaatagtgtgtttcgaccgaataggaggacggcggttttccccctttttccataaactcaagcacggtttcggccgaaaacacacatcgcccttacccgtgaggggcttgttgtagcagggtacaaacaccttttcctccaatttggtcaaaacactacgaggttttgcaagacctaagtatccagaggggaaaacactcattttgagtggaaactacctttccaagaggaagaacacctttcccaaaaggaaaataccttcccagaggaagaacactcattcgaatagaaaatacctcttcgggtgaagaacaccttttttagggacattccataatcgctaatgcaactacacatattttggacaagttacaatttcacaggtggtttccaaggatgaaagagaaggcaaaggggaattcgaattcccaggaggaagaagacggtccaggacggaaaatgcatttttcccaagagttcgaggaagagcactcctcgaacaagagaagatgccaagggaagattccgtggggtccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccaccggttataaaagccagtcaaaaacctgtagcaggacaagacatctttaatacaaaagtaatcctcaaaagttgtgtttgctgttcgagctcgtttctaaggataggcgggaaaacacttctttccggcctatccccgatcttgttcgtgacctaaggtcacaacatcggtcattagcgtaggccaaaaatcttgatgaaaataatgccctgagatgctgagaaaaaaaaattgaagttggttgttgcagatgtaatttcctaagaatcgtatacatgttcatcaggtattttagttgatgcattgacacatggaacatctattactcccaagatatgcatatacggcctgaaaagtagtagagcaaaagattagtttaggattagattctcctatatatatggtttttctcttcaagaagttgggtattctccagggatcaagacaaatgttatatatttctcaataactactaacaagaacaataggatggcttcacagtgattagtggtaatcatctgtattacaagcaaaatttagagcctccagtgatctgaaaacatcacattacctccaaacaaagaaataataataatagaaccagacaaaattttcctttgtaaagttcagaagaaagaatggatgcaaatccattgataggggctgcacaggatcaactaagaatatggatagacgccttccaaagctgccatccttaaggctagcctattaatcgactttggctacctaattcctggaagagcttctcctgatccaagacatatatgatcacgcaaggaggagacaatatgttaaaatcttcaaactctatggccaatttctgattggcaattgtgaatgatcaagaaaacaaatggtgatccacaaattgacacatcacaaaaacatgtaaaataggagaaattggtattaccttagggtttagggggaatagggctggttggccggtggttgatgtctgacggtttcaggagcagagaacagggagggggcagcagatggagcagatgccggatcggctgggcttccctggtggcggcaacctcgacggcggaaccaaccggatcgtctcggactcagcaacaagcatgaggaactggcggcgcggtggagatggctgtaggagcggtggatggcaagatacaggcgaaacagtgatgggggcgcgatcggcagggcggtggtcgcagcggatgggtggagaaatcggtggcggcgggggaagggacgacctcgggggcagcggtggactgcagcggcgatggcggatggggaagatctcgtctccggctgtgcggcttcgttggcctgtcacgaggagggaggatgcgcgcgaatcgagtaggagcgaggagggcggcggggattcgcggggaggagtcagcgcggcggggatttatgcgaccgagtcatcgcgaggcagaggaatcggtggaatcgctcataaatggcgtagaggatagtggacggatgagattagatcagatggtggatagacggatgagattagaggggatgatttcacctgtaggattggaggggtacaactcctcctttttatattagtatagaagtatagattcttttcaaattcaagacttgaaggggaaactacacagttcaagggaaaactatacattatttggtgaaaagcaaggagaaatgcaatgctgaaatacatgagttatgcattgcagtaataagctaataatacataggtactccctccgtttcaggttataagactttctagtattgtccacattcatatagatgttagtgtctagattcattaacatatatatatgaatgtgagcaatgctagaaagtcttataatatgaaacggaggaagtaataagttaagtatacgtttttgaaaaactgaactgtttcaccaaatgattcaatacagatcaaccaagctgtattcagtcccagtactccaaatagggatatgtaagaggaaggaaatcagtttaaaagatgggaaggatttatctatacctggttgtgtagtcgcaatcatcaatgtgctagacatctaggccattgaaccaggctcctaatgatgggtaagaattagataaaaaacaaatttatgatgtagataaacagaaaccgtgtctgaagaaattgcttactggttgattgatatgtaagaaaccagatccttggagattgcatagaactgaacggttgcatgcctaaagtatttgttccccccattcaccaaattgccaatactcaggctcaggatagtatcttacaccccgagaatgaaaaacgatctagcatttggtcagcagtttaaaatatcagccaaggcatgacaaaaacaggggaacttacttctgagccaggactggaccagatttcatgcagccaatgtaagctcgaggtttcgaccaatgcttagcatgtttccaagagttgctgcaatatttgcaatattattagtacagtgtcgctaaagttgaggtaaaattttacagcctaagttttcagctttagcttcagaagcaacatctctgaagactatgtatatatgagatttcatgaacttagaatgtatagtttgcatcaaatacttagaagaaatttaatacaaatgaaatgtctgaataggtcaaatttaagcaggaaagaattaagacttaaagaaggaagatgatgttagatcatagggcagtagttcgtacacctatatttacatgtagatcaacatccactttaatgtagcactctgcagccaacctggacaaggatttcacaaaaaatgattgtctttgcaaccaactccagatattctttcaacatgatcctgagcaatcgacagatattccaagatatttcgctgttacagacaaataacagaccattaatactgtactctaccagttaaagtaagttctattgtactacagcctatggtaattaccaatctaaagaatccaccatgtttcctattttctgcatctatagctctatcgagtatcccaccagatgttgaactgtcaaataagataaaagatgaaaatttcagatacattgagcacaagatttttttacttgaaagtaaacccaagttattgtcagtttatattgctgaataataatactacctccgtttcatattataagactttctagcattgctcatattcatatatatgttaatgcatctagacatatatgtgtgcctagattcattaacatctatatgaatatgagcaatgctaggaagtcttataacctgaaatggaggaagtagtaaattggaaactgtttagtctagtaagactgtaagagaaactctccctttactatcgtccacaatagattgcccaaagtacgtgttttctattttcctctacaaaactatgaccgataagaaatgtaattattttttcttcctcaaatcctcttctcccacctgttgtaaacacagaaacaatgtcatgtaacatgaccttttttttctgtggcaacaaagatgtgcatgcaagacaatgcaaaccgtgaggaagcagcggcaataacgattcccttgaggccggctcctagcatctcctccctcgggagcttgcaactacagcggcttgagctcgctctatagctgctggggatgaagggcagagaaaaagaggcaacatcatagacgagatggcccaggtgagcgaggaaaagtggttgcttagacacctcatataatcatgtatacaagcacatatttgaggatatctaattaattaatgcattttacattttagacttatttgtatctttagttgggatccgttgcaacgcatcaaaacagggtgccagtgtccaaaaacacagtgaattcaaccatatgtaagcatgcataattccagatcacttgagtgaagtcttcaaagcaaacgatatggaatatcagaacagaacagctgagaacataataaacttactaaatatctaaaggaactgcgtagatggaaacatagctaattagatgtcgtatattgtcagagggtcagtttttccaatttaacatttgtattcaccatcgctatggtacaacattactgattgagctacacaagctattgccaaatctcaaagatgtaaactatgacaatccatgactcgatgagtgtttatgcaacttcatttgtctagaatgaaactcagcatttaaaattaaggcgaggggtacaaattgtgcctcaaagtgggctaacatagcttttggttgtgagcaagactacattaattactgttaaaaaagttttgtacagaacattttgaaaccaaattaactttacgacttttcttaaattggctgttaaactgggttgcatgaaaaatgaaaataaaggatgcagcgtggaactatcttagaaagtgtgctctagtagaggaaaaattaatccgagtcaccctaaactttcatcccattactctaacacctgaaggtcctctgcctgcaaaacacttcaaagttttcttcttcctttgtctctggggactctggaaccatcgacatgatgtagtttttaggggtgcatcaccttcaattgattgtcttatcgcaaaatgtaaagaggatgcaaccttgtgggctgaaagattgagccacgctgacagggctgttgtagagtcttggaaacttatcttatcatcccccctcactctaatgtaacttaagctactgtactgttcctcccttttaatgaaaattcaggtggggaagctctccccccccccccccccggtgaccagtctaaaaaaaacacctaaaggtcctgaactatagaacatctaaataatatgtggaacttaaaaagccacaaacagtaaccattaccctttatgtaaggaggcatttaacctaatcccttaagattggtaattaattaattttccaggacaacagtccaaagagcttgggccatatccacactatgcaagcaagcacaaattgctttcattcggtaattttgcatttcattcttcaccttggatagctaagtggcagtgagcaaattaaatttaaggaaaaaggaacctcatgtcagactacttccgccttaatctgaagaacaacgatataacactccaaagagtgatgtaacacagaacatcacacaaagattggactcgctcgaacaacttattgtacataaaatgcaattcccaaatcttgtttgcatctcaaaatatatactcatatagtgcatcaattcagcaggttatttccttcaaatttacttttgatgaataaaaatacttgtactagccttcgtaggaggacagcaaatttgctagcgaaccagagaggcaggtacccagcatttgcccttaatcaccccctgaacgcggcagctcagacgcaaaaaccgaaaaaacaaacccaacatcggcaataggaatcgtgcaattccaccccgaaatacgcaaaaccctcgcggatcagggcaaggcgctcagctagagaggggaggggtgtcgctcaccgcagatcttgacgggggcgtggatgcgcaggaggttgtgcacttgggctgcgataggagcacccgcttgacctcgacgtagagctgccggatctccgcctcggacaggacagctgcacctgcctcccgccccgccgtggcagtgcaggctagggctctgtcaacaccctcctccatgaacaccctccgccaaaccatcgagctcgccgcctcagatcagggaatgaccgaattaaatttgaaaatacactgatcattcaattttttcttagaaatattcgtgatttaaaagtttttgtgaaaatataccgtcgatatcggtatcgcgcggtgaaagcgcggtctcgcagaatgaaagagggagagcgaacgctctcgcgaaaccaaacagcgacaccgtgcaatatctccacttgatttgtaattaattactcaaataaaaattaactaataataattagtaattaattatcctgattagcaattaattataatcactaattaaatcatcacggcagcggtatcgctctttgctctagcgagactgaatggtgtcgccctttcattccgcgataccgcgcggtctcgcaccgttgctacgtgagaccgcgcggtctcgcacttttatcacgtgataccgtccgtgacgtcatgtccacatcatttttgcacaaaggttatgcgatatcgacggtatatttccacaaaaacttttgaatcacgaatatttctgagaaaaaattaaatgaacagtatattttcaaatttaattggggaatgacattgagttgaggttgtggctactccctccgctggaccggcaagttgacgacgaggcaccgctctgctacgcatcatggagacgagacggcgtggcgctcggctcgagtcagggaatcgtttctacgccacctgccttctcccatcggaatatataaaggggcgcgggttgggcgggcgaggaggtgtgccacgtcagaattttgctatagtatgcacggtgcgcggggtggtattttttgtgaaaaaaacccttcgatttccgggtaatatataagggcctgttcggttagcccggggttggccgggaatgtggcccaacccacgggggtcatcccggtgtgaaaataatcccggcccaggcaaaaaattgcgttcggttaagccctgtcgctgattttaatccggcccatcacggggttccctattgtccaggcccgggaaaaaatcatctactgtggaggcgtggaaaaatacatctcgcatggaggagacgagaaggcagcggcggcgacgcaagcgcgagtgcgagtgtcaaccgcgtgacggcgcgacggcaacactgcgctctccccggcggcggcgctctcccctccgctggccaccttcccaccggtgagtatctcttcattcccctctcttctccctgtactacctagggtttggaactttggatcttggttcttgaagcctagggttcttggttctcaccggaccgtctcctacctaggattctgtcgccgcctccgtcgccgtcctcgccgtcttggaggtcgccgtcatatccgccgtcccctcgaactccgcggctgatgcctgttcttttttgttttttcgcaaaattccttttcatctttcgctgcttaattctgcttgttatgcgtatgaatcaggaatccacagattctctttaatgtcaactagtatagttggttccaatcttcaagaatcaccatttctacttgtatgtttctcagcatgctgatgttgttattagggaggtgattctgtgacggctcagtagaactctattgtgcatatgttcttctattttgatgaatcaccaatgattattttgtgtgccataaaactctattgacaaatcaccaataatacttccaatgcttttttctttggtaaaaaccacaaatgaaggtcccttggactaattaccatattacttcaatttataatataaatggaatatgcattatttgttttattatagtactttccttggttatttttctatagttcatcttcaggaatgctagatctattgttgctgcgtatggggtgaaataaaggaaatgcaatgcattgctgactttgtggggaatgggaggaagtcctgatgttttttttattaagataatatatgcaaaatgtgtgcactgatattatgttagacccttgcatttgatttctctagactcctacagaacttatattattgctagtgtcagaatttgaaaagccacgcaatataaaaaatgcacataaaaatttctttgtacatgtacaggtaatctaggagccaaccatatgctcatatagaccgtgtttagttccactcaaacttcctctcaactcccaactttccataacatcacatcacatccaaaactttcctacacacataaactcctaactttttttccaaactaccaactttccccaaacttctccccaatttcaggaactaaacacagccctaattgacctgctagtaatttgctttaaaattggtacaactatatgaactggaaactttagtagtactatatactgctctaactattactggtttttagacctatatatgtgcacgctccatatccatatgtactctcattgtttcttgatatactagttaggaggacgattacaggcacatatgattctttcccccaattcagaagtacttgatattgtcctattcatatgcatgctcttgtattagaactttaggagcaggaaaagaaaaggcaagtcactgttttatttttgttagccatccaacttacagtcagcaaatatttcctatgtcatttttttgtcttaatgttattctatttcctacatgtgaacttttcaatagtatagtattgatttgatatatgcatcaatgttcttggccatcagcaattaagcaagtatatttttttctgattttttatcatcaatcacacacacctgttatattttgctgaaagatagattcttggttgagatgtgcaagcagcaagcaacaacctacagagggccgtccattattttaaatttcatttttggtagttaaaggccgtgtttagtttcaaagtttttcttcaaacttcaaacttttctatcacatcaaaacttttctacacacacaaactttcaacttttccgtcacatcgttccaatttcaaccaaatttctaattttggcgtgaactaaacacagccaaaattatgaaaaatgcacataaaaatttctcttttctacatcatagattgagatcacaaccaccaattcgaaacaattgctcattgcacagaagtgttccttaaattatgcagtttcagtcagaaactaaagggaacttttttctctgcaggctttgggaagaaggaagtctgcaaggatactgcttttttgcggcatcagcaaatgttgatccctgaacctttgaatatgtatattgttgatgcaacctttgaatagaacaaatgttcagacttgtttaatttatttaatttgtcaggtcgtctcctgctgctcgtcagctctccactcatcttggacttgtttaatttgtgatgtttccattttcattggttcatactttcagtcataactgtttttcagtttattgacaatggactaatatgtacaccctccgtcccaaaaaaaacccaatcttgtgtttgaacctatcaggattgggtttttttttcctagataggttcaaacccaggattgggtttttttggacggagggtgtccaggttcaaacccaggattggaattttctttggggcggagggagtattcggttattattgagcatcagcattcatatattcacgttggtcagcagtttttagatttttctagccaaaatcccagccaaaaccaaacacagggtttctagagagggattaggaaaagcaagggattcatccccaacagggattaagtgatatgagagggattcacttaattcctccctggattgattctccttggggattaaatccctagtaaccgaacatagcctgaaggggcgcaggttgggcgggcgaggaggtgtgtcacgtcaggattttgatacagtatgaacagtgcatggggtggtatttttgtgaaaaaaccctttgatttccgggtaattcgatcaaggtcccttgagaaccgtgcctatgaggtgtttattttcatggaggcccagatattccgtgcaaagaaaagaaaaatcgtgaattaggactgtgttgtaaaaattaaaagaagaggggctttttcgaaaaatgactcacactaacccacccaccccagccctagctttttttttacaaataatacgatttaatgaaaaatcgcaaaaatataggcaaaattttacgtttaggggtacctatcgaacaaattcaacaggtaccacagggtagttggtctaagaaaaaaaaatagtactttgctacagtgcccccacatggacatatcgaatagtccagatttattaaacgggcaaagtttgataggctgcgctgttacagtgtcactacagtgtttttcttttttttttaagatattttatcactcgtcgaactggcagttcaacaagtacctatcgataggcgaacaacggctgttctataggtgctagacttgcgatttcatttaaccgaccaatatttttgctccattaaaatcgtattatttgtaaaaaaaattcctgtcattctcccctcctccccttcgtctcaccctctccctccgccgtcgccatcgtgccaccgccgcctcctccacctcctccgccaccgccgtcgcatcgccgtctcggaggtcggagctcgtccgcctccgcctcgcgccgtcgccgagcgcagccgtctccgccgagcaacggtgaaggcgggcgcagccttcatcagcgacgaggtcgtagctccgacgaccacgccacaggcggcgcaaagagctgacggcccagatcctggcatcgggagccacgccgctgcgcccgccgatggcgacggcgaggaggaggaggaggccccgtcgccgcgtccgtcctccgccggctgctacaccttcctccgctccgcgtctcgccgcggcgggcactggcgcctcgactcctccgcctccgcgtccgcggcggcgcatgtggtcagggtggaggtggggacgacgaagggagagaggaacttgttcccccgtcgacctggccgtgctcgaggccgggccggtgcggcgcctcctcgcggcggccgggcggcggacccgcggtggcgttcgccgtggacgcgttgctgttcgagcacctgtggtggctgcagccgacgccgacttcgtccctcccctcaccatcgtgggtcatcgattcccctaacagccgacccctcgcgccgcccgactccgtcgacgtcatccctccccttgccatcgtcggccgacgcgccgccaccgcgccgccgccgccctcccacgcagcagatccatgccgcaagacgtccatcggccacaaccgtcgctgccctcccctgcagcagatccacgccaccggccgccgccctcgatcacaacgtgatttggaggtggagaagcttggtgtgttacgagttcattctcaaatccgctaccctcgatgacagcccaggctgcggcttcttcgccaacaccagggtcaaccttgccaacgatatgtgagttagcttcttcctctctacggagatttctggtgatttttgtttaggcggaacagcgactacacgctgatgcggttgctggcacaggcggacgccatcaacttcatcttcttcaccaagatggacattggtgggttgttgtgctgccttcaattatgcagggttgggttggactctatgagggtttcgagggcgtgtgcatttgttgaccatggctgcgggtggtcctcacaccaacagcggccggtgactccatgaagtatcttgtctggatggacggtgagtgaatggctttcttttttaactttgtgactggccctaattgccacctatttctatacattcacctgttcatccagcgattccagaatgtggcagtggcagtgcggcttgccttgatttggtttgttgtgctccacgattatcagttcagaatgtcagataagtgaaggttggttggttaggtagcaggaagttccctgatcaatctgttatttgtcaaaatgtgacaagcatacttatctctttgttttgtaatgtggtgctatctagctgggatgtcggtagcggtcgttgaagtggctgcggcgacgattgcttcttccttggatgggagccaccgttcgccgaccttgctgccgccgacgcccgcatatccttccatgtctgtgtgccagaggtaaacggcagtttctttctgttcttccaccgtttgtgctgatgaatgttgtgcattccctccttgtttgagctcggccatggaggagtcaccggtatctctgggctggcggtgctagaacagtacacacggtcgtgttgccggtggagctggacggccttttcagggtgggttcctgcaggacagggcaaagacgatggttttgttgaggaatttctgtgacgttatgagccattatgttgatctgcttctgttttccttccaggatttgtgggatgcaagcagcagcagaaacagcgaccgagcacgtccgattccagctacgttcagcgtcatgtatgggaaggtggggatcagtgccgacacacacccccagttctacctccgattatttcttcagcgatagtcttaattaatagctcttgtgggcagtcattgacaggcatggtgtgtacttaactgcttattgaaatggtcaggtttactttccattcgtaccggttcatgcattgttctgctccaaatattttcctttattcgaggggattggcggatgttcgcacaggcatggggcgatccggtttcatctattttgttgccaggtactcgttgtagcgttagctaccgctactgctcgtgcctgctggcagtggccctgtttagatgggactaaaacttctaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctaagggtggtgcactactttgctatatagagagcggcaattactataaataatgctattcgttcatttatggataactattgagacaaaatcattgagtagcaagcaaaagtgcttaccgaaatataagacgaaaagaaaccgcgaaatggaacatcaaaaaatacatagaagacgattaatctatgcaaaattcatcctcgggctcaaagctgttaatctcaacatcatcgatagttaatagcccacaataaatctagaacaaaagtcagaaacattttaattttgaactaaaaatttatatccgatgaagacatcttaattttccatccatcttaaagtgtcacagtgtgcttacaattttactaatgatggtctgatggactaatggatgaaggacaacaggagtcccttcaagcagagatgtttaatggaaacttcctttcagttcttcaaactttgaaccctagcttatataaatctggataattgaaaaagtagaatcaagttacaaatcaaactaattggattaaaaagaagagtgaactagaagagaagagaggagtataaattgaaaatctgaaactaatcaagagaattagagagagataattagatcattagatgaatacctctcttcagtttgcctgtgcactgctcggttgccctactgttctgcgccctttgcctctgtagtcctagtccaggcgttcagctggcagctactgctgctttactaccggcggccggctagggcgaccagcggcaggacggcgactcgacgagcccgcgggccagcgatgcagactgcagcctgctggtgcgacggatgacgaagacgaacagacgacgcggtatcggtggactcgcggtgggggaaaagaaaaaaaaaaaaaaggagacgaggcgcggctgtgatactcgaggcgtcggcgcatcgctcctgggcgtggggggcgtctcctggcgttgcaaatgggccgttgcttgctcgctcatgggtcagggtggtgcacactcttgggctgagggggttcctatgaggtgaaaaggaaaaagtgcaccgaaggtccctcaacttgtcatcgacttacaaaatcgtcctccaaccgcaaaaccagatatccgacgtcccttaactaatcaaaaccggtcacaatagatctttcggtagttttgataccggttttgtcttatgtggcggcggagtcagcgtgggctgaccccacctgtcagcatgccacgtgagcaccctctcttttcccctcttctccctccctcctcctcccctctctctctctcactcttgttttggccagcccgtcggcggctgggaggaggccgcggggacgaggtggcggcggccggtcgcgaatggcagcggcgactctgcgtcaccgccggcggcgaagtggtcccgcgcgggcggccgccgcggcgttgggcacggaggccgacgaggacgtgacgcggcgacgacgctggtcctccccatcctcatccaccgcgccgcgcacggacggcacgcctgctctcgcgccgccggccagcggagagcgcgtgcgaagagggaggaggtggggaggtcgacagcgagcacgcggagagagggaggatgcggcgcgggagccgcggcgcccgcccgcgcggggccgcttcgccggcggcggcgacgcagccaacgccattcgcaaccggacgccgccgcctcgactcgacgtccttcttcggatcttgctcgcccgccgcgccttcatcctccgcgaccagctcgtcgctgccctcgtcaggagctcgcctatgaagttctcgtggagctcgccgggccagacggggtgtggcctgagcttgcagcacatctcccatcagatatacttacacgcttgtggggacgctgacgacgccgaagcggtacgagcgtcgcaacatcgtgcatctcgatagcgtacgcgctgcagccggcgatgcccgcgcatgtggacgtccgcttcgtgttctgctccgtgacggatgtttgacgatattttgtcattttacgttaagcaaacaagattactatttataaaagaagctagctcgctggtttttatgagatgcatgggccatgcaaactctcgctggcggcggcgctggacgcaatggtgggacgaggtgggggaggtggctggggctcgtgacggctgtgtgggtgcagtgcatctacggcaagaactacaccatcttcaactaatcccactccatcaagacgctcatgggcctcacccaacagctgctcaaaacagcctctccgtcgccaaggaagcgtcgggccgtcgctgaggccggccagctctgcgccctccccgacaccgtcgcccagttcttccgccaccgccgccttccagtttcttccccgttggccgccggccgcgccaagctcctcccccgccgccgccgtcagttcttccccgtaagccgccggccacgccaagcgtcgtcgccgcgtcacgtcctcgtcagcctccgcgcccaacggccgtggcacccgcccgcgcgggaccgcttctccgccggcggtgacgcagcgtcaccgacgccattcgcgaccggcctccgcctcgccccgacggcctcctccccagccgccgacgggcttgccaaaagaagagtgagagagagataggaggaagggtgaagatatagttggccatgtgggccgcccggcacggcacggcccaggcccggccgtgcctgggccgaggcttgtcgggccggcacggcccgaccgacgcaccgggccgtgccgtgccagcccacgtgccgcgctcacggcccaggcacggcccaacacgcctcgggccgtgccgggccggcccgaaggcacgatgggccgtcgtgcttttcctcagaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccctatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactataggtgaagaggggaaaagaaagggtgctcacgtggctatagatggccaaaaggcccgaggcccgatggcccggcccatggcacggcgttttggcccggcccaagcacggcaccgcccgtcaggggttgggcacggccgggccggcacggcacgatgggcctcaggctaggcccgacacataaacaacagggagtaaaaatagacatattatatgccatggtcgaaagaatagggacgtaaaataggcttattttagctatatatatgtcaacccaaagaggagggacagaaaatagacttattttcactatatatatgccacagcccaaagaagagggacggaaaatagacttattttcgctatatatatttcacggcccaaagaggagggatggaatatagacttatataaaaaggcacgatggaccacccgcgccttcgggccggcccggcacggcccgacggctggtgggccgtgcctgggcgggaggcgtagcccatgggccggcacggcccggcacgaagtgccaatcaggccgtgccggcccgatgtctggtgggccgtgcctgggccgggccgtgccgggcgggccaaaaggccatctatacacgtggcatgctgacaggtggggcccacatgggtcccacgctgactcagctgtcacgtaggacaaaaccggtatcaaaaccaccgaatgatctattgtgaccagttttgattagttaagggacgtcggatatctgattttgcggttggaggacgattttgtaactcgatgacaagttaagggactttgagtgtactttttccaggtgaaaatgaggggtaactactaaaaggaataagtttataggaggtccctcaacttaacagcgagattttttaagatcctttaaccacaaaatcagaaatgtgtatccttaaacttacacaaaccgtacacataagttcctatggcagtatatatgggtgtttttgctgacttggcatcctagtcagcaaaataaattaaaaaagtacatggggcccacttgtcagctacacatattttttcttctcctcctctttttctctcttctttctttccttcttccgttcttcgggccggcggcgggccggatccgcgagcgcggcagtgggtgttagctgctaatcacccgatcgaacactttgtgcgcacactgcacacgtccggcacggcaacagacaaaaaaaaactgaagaacacaggaagaaattcagaacagagaagcagagtatttcagagtttcagagaatcacgagagagaaggaatttgtgggacaattttctgggttctttcattcaactgaattgaaaaacttacaaatggaaattttagctacggctacttatactctaataacagaaaaaacgaatccaagcctacaatcgcgccatcccacgatccggaactcctggatccaatgtcgtgcaaaactcacgcccacaacgcacgcctgacgcggtcgtctactcctgcagctcgccacatctctcgtgcatgcataacaaactcaaaactgaattattcatccagccgttgcaactgccatcgcctggatcaccttggggccatagctgaaataacagtcaacaaactcccccttaattctgctacggcccaaaatcacgaacacctagcaggtgtcgtgctgtcgccaatctcgctgctggcaacccttttgttaacgcatccgcccgctgctcctcagtccggacgaattcaatctgaatcttcccactttcaacacactcacgaataaaatgataccgggtatcgatgtgcttacttctcccatgaaacacagggttcttcatgagtgcaattgctgatttgttatcaacatacagcttcaccggcctggcttctgcaccaatcatctcaatcaacaatcccctcagccacaaagcgtgacacgctgctgcagtggctgccatgaactcagcctcacaggacgaaagtgccactgttttctgcttttgtgaactccatgagaccaaactgccgttgaagtaaaacgccatgccgctagtactccgacgatcatcactgtcgccggccagatcacaatctgtgaaaccagtaatctccactgcaccattgcctccagaaaacatgagtccacagttgattgtccccttgagatatctgagaatttgcttcaccgccttgaaatgcatcactgtcggtcgttccatgaatctgctcaccacgcctactgtgtaggacaaatccggccgagtatgcaacaagtaacgaagacaacctatcactcgcctgtactccgtgggatcaactgtgcttccttgagcatctttgtgcaactgtgaacgatgttcaataggaattgaggtagaattgcaatctagcatcctaaactgggtcagaatcttccttgcataagcaacctgcttgatggcgatcccgtcagtgccttgcaacacttcaattcccaagtaataggtgagcagtccaagatcactcatctcaaactcccccatcatctgttgtttgaatgcagtgatctcgcttgggctttctcctgtcacgatcagatcatcaacatatactccaacaattatcccggcactccctgtacctctagtgtagactgcttgttcttgtgcacaccggctgaaaccaagctccttcatgctccgatcaagctgtgtattccacgcccatggcgcctgtctcagcccgtagagagctttgctcagtttgtacacaagatgttcctttcccttctcaacaaaaccttctggctgagagacatatacttcttcctcaagatcaccattaaggaatgccgacttgacgtcaaggtgatgcacctgccaccttcgatcagctgcaactgcaagtatagctcgcaccatgtccaaccttgcaaccggcgcaaacacttcatcaaaatccacaccttgccgctggaagtaccccttcgccaccagccgcgccttgtgtttgatcacttcaccggcagtgtttttctttagcttgaacacccacttgagccctattgccttgtgaccggctggcagcatgcacagcgaccacgtcttgttcttctcaatagcctccagttccttgttcattgcgttcacccacgccggctcgccggctgcttcacgataggatgtcggctcctccatctctgcgagcagcgcttctgtgtcatcatcatcctccaccaggtccacccgaggtgcttcaatcatgatctccgccaagcttctgtaccacaccggcccgtcgtcactgtcggccgtgcgcggtgacgcctgcacctcggcagagtgcgttgaggatgagccgagtgtaggcgtgctaggcaaggttggtgagaacctcgccgggcttgccggaggtgttccccgctgttctgccacttctggctccttgccggctcgccttcctgccggcggcgcccggtaccacggtaccgagcctgcctgctctgccggcgccggctgctctgcgccgacgggttcttctacctcgaactcagtggaagtcacctctcctgcagcaacactccactgccaaggtgtgttttcatcaaaaacaacgtcacgacttacaatgatttgccgacgacgcggatcaaacagccgatgggccttgctcccttcttcaacgcccaggtacacgaccggattgctccggtcgtccagcttcttcaagtgcggtgcagtcaccttcgcgtgcgccgtacacccgaacacccgcaggggcccaggtgaggtttcttccccgtccatgcctcgaacggagtgcgatttcccatcgccttggtcggcagccgatttaggaggaatacggcgtgacgaactgcctcgccccacatcctgccgggcacggacatccccttgaggagagaccgcgccattgccatcaccatcctattgcgacgctccacgacgccattctgctgcggtgaatacggtgccgtcaggtggcgctcgatgccggctgcatcgcagacgcgcgcgaactcgccggacaagaactcgccgccgcggtctgtccggagtgtcttgatcgttcgtcctgccgtgttctccgccaacggcttgaacttctcgaaggccgcgagcgcttggtccttcgacttgatcacaaacacccacatccaacgagaaaaatcatcaacgataaacataaagtatcgattaccggcgaacgtcgatggagtgatcggcccacacagatccatgtggagcagctcgagcggcgcctctgctcgatagtttgccattcctgggaacggctgccggacttgtttcgccaccagacatgcttgacacagctggtttgggtggtggactgcgggcactcctgccgccatctccttgtccaccaatagcttcaatgcatggaaattcacgtgtccgagtcaggcatgccacagccacgccgggtcatcgagactagccaacaggcacaccggtgacgccagctgtagctcgatgcggtacagccgatttgaggatcgccgcaccttcatcaccaatcgccaaggatttttgtcgaacacctcgaggtcatctccatccatcacgacacggtggccagtttcagttagctgccccaaactcaccatgttgcagcggaggctggggatgtagtagacatcgtcaagcaaccactggtcaccgttcttgcatgagaaaaggatggatcccttccccattatctgcactgacgaggcgtcgccgaacctgacctgccccgtcacggtcttgtccagttcccggaatttccgacgatctcctgacatatgattgctggcaccattgtccaggtaccacagatcaccagcagctgctcccttctctgccagcatcaggcgaggccacacacgctcctcgtgcacgaccagcccgcagagcgcatcctggcgcggcgcgttctgcaccgcctctgtcacagcgagcaacaaagctgggccagcatcctccgtttgcgcaagatgagcttcaaccttcttcttcttgggatgtggacactgcgtggagtagtggccaaactcctcacagttgaaacattttatgtggctcttgtcgcggccaccgccgccaccaccagagccgccaccgctgctctgcgtcccgccgcgtccgcgacccctgccacgaccacgcccggcctggccgcggttcgccccctcaccagagggcttgttcttctatggtgacgaggtttctcccccgcctttcttgaagcgcgcctcccactcggcctgagtgaggagaacttgcctgtccgcggtcactccgccggtggtcgccttcttcttccgcatccgctcttcatacgccttgaggcgacctaccacttcttcgaacggcatggtgtcgacgtcgtaaaattgctcgatccctgcgacgaggctgatgaacttctccgggacagtgtcgaacagcttcttcaccatggcggcgtcattcaacgtcgcgccgagagcagagtaccggacccccatcgtggtgatccggccggcgtactggtccagcgtctccccggcctccatcaccatgttggtgaactctcccttgagtgtctgcaggcgcgcatcgcgcacccgatccgccccgacgaatctcgtcttgaggcaatcccaaacctcctttgccgagcatttctttgcaacctgcatcaagagatcctccggcagcgactggagaagatgagactttgccttcttgtccttcctcgggtcgacggccgccccggccgccggctcgattgcttcccatacgccttgatcctccatcatagcctgcacacgtattacccaactagtgtagttggttgacgtgagctgtgggtaaaggaaagcacttcctgagctcccccctcgccgggtctgccgtcgccggaaccaacgccatagtgccagatccgccctcaacctgagaagctctgataccacttgttagctgctaatcacccaatcgaacactttgtgcgcacactgcacacgtccggcacggcaacagacaaaaaaaaactgaagaacacaggaagaaattcagaacagagaagcagagtatttcagagtttcagagaatcacgagagagaaggaatttgtgggacaattttctgggttctttcattcaactgaattgataaacttacaaatggaaattttagctactgctacttatactctaataaaagaaaaaacgaatccaagcctacaatcgcgccatcccacgatccggaactcctggatacaatgccgtgcaaaactcacgcccacaacgcacgcctgacgcggtcgtctactcctgcagctcgccacatctctcgtgcatgcataacaaactcaaaactgaattattcatccagccgttgcaactgccatcacctggatcaccttggggccatagctgaaataacaatcaacagtgggcgagcgcggcagcagagcggcggcgggctgcggacggcgcgccaacctcctccgaccacctccgaacgcatcggcgcgcgcggtgacgaaatcccccaaactggcaaggcagccattcctcgtggtcgcgaccgaggggcccaatcgcggcgaggggaatgggttggtggccggaatcgagctaggtacccgctgctaccgaggtggtgctcgtgcgcctcgcctccgccgtgcggaggtaccctctgggctgcgggagagctgccgccgcgtccaaacctagtaaagcgcaatcagcatcgcgcaacggcgaggcggagtcaatcggtggtgattagaaggtggaggtgaatgctggctcagtggctccaatgcatggttggatgaattgcagaggagatgcaggtggtgcgcgggaggaagttggtgggcggccttgggacctgactgggctcacgttaccaccattcctgtcgtgggcgcagcatgggaggaggtcgcagcggcagaagttgctgtgaaacatgtgtgaagccttgtgcttacttttgctaaactgggtacatgagcttggtggatgatgatcagatcgacaatgaaagacttgtgcaaatttgatcattacagcggccggcgacgctggccttggccgtggcggggtcagccagccgacccaacccagctctattcgaagctatcggttaagtagtagttcgatgtcttcttgctaagcacggccgccgttcgacgcgggcaccatcctctctcctacaccgacatggtctggagcccgacgaacccatcggcgtacacacatgaagctccggggcatcgccatcaactaagaagcgcgcggtccacctccctcccgccgcagccagccgcgttggtgccgtcacgcgatgagcggcgagcggaggaaggggcagcaatggcggaggtccaccgttgcactcgcccgccatccgctccgcgccgcagcccgccgcacgctcgccagtcgtccgcagcctgccgccactctgctgccgcgctcgccgattccgcccaccaccggcccgaagaagggaagagagaagagagaaaagaggagaaggagaagaaaaaaaatatgtgtagctaacagatgggtcccacgtactttttttaattttttttgctgactaggataccatatcagtgaaaccacccatatatactgctataggaccttgtgtgcacagtttgtgtaagtttaagggtacacatttctggttttgtagttaagggaccttaaaaaatctcgctgttaagttgagggacctccggtgaacttattacctactaaaactgaaaattgggccgggtgcctatgaacccccctaggcccattgggctccgcccctgcctgctggtgtatgcatgtggtttatcgaattaaatttgaatatatattcttttttagtaatatgcatttatatacgttggagtcaaatatttgcgcaaatatactttccccgtggactggggaagcgggaacgagatggcaacgcagattggcagtgcgggaatgcggtcgcgcagaacgggtgtgcgggaccgactcggtcgcgtggaatggatgtgcgggaccgagtcggtcccgcggcgtggctgcgctgagtggtggtggtagcgggaccagtcagctggccaggcgatcgcgcggaccggaggtgtgggaccgagacggtcccgcagccccaatccgcggaaccgatagcgctcctgcgggcccgcctccccaattagtgccgctcgattgcgcagagtggaggcgcgggaccgagcggtcatgcagcgccagtctgcggcaccgtgatgccggtcccacacccttctcccgtaaactgaactccctcgttaacaattttaagtgcaactataaatttcaatgtctaacctagatggtttattttatttaattttcgttataagtagtatttttattattactagatgataaaacatgaatagtaaattatgtgtgattaataatttattttttaaaaaaataagacagacgatcaaaattaggtatggaaaacaatgcactgctactccgtgcctccattctgcgggatcgcaccgaaagtttttttgtccaccgaaagttatttgtcttctctatgtcacatgctcgccacaaacaaagagagagtgatgctagatttttttcgcgtgctgtccgccgaaagtttgttgtcgtctggttagagaggttacttgttgagtgcctataaaaggaacgttgcgaaacgaaagatgcggactcaagtatagcgtatcacttgtgtaagcttcagtaggttagtgcactttgcgaattcgcaggccctatcctgtggtatgaactgagtacgcgataatttatggtgcatattaggggcttaccataagataatgccatgaattcgcaaagtgttcaaacccactgaagtgtaaatatttgtaagtgttcgtgatggtaaggcaggtaagtatttcaaatttatttatttagaaatgtagctgagatattagaaagtttgaacacaaaaaattacaaattagttcgaatgagcccaatataaaatcgttctattcctaagcctcatcatcgaaatttcgggacgtgccagtttcctttttctttccctttcttctagcaccagttggaggtctgcgccctgacaaagataatctttcaggtgaatatcgctcgcggacagacctacggacgacttcaacaccgcggagatcaacatcgtcgtagtcttgggctggctgagttattggtggtggttcatcatgttgcaatggtcctatgtcgtgttgtgctgttgacgagcccccaccgtagctacatggttctccgtatgactgtatgctgccggcatatcccatcatttgttcagggttgtacattcctacaaaacattgaatgcaaagttgtagcgtgcacacatactgaaaataaattattttctagtaaattataagttgtacctgttgtttgtggttgcatgataggtggttgattgaacaaccaatctccatggcctaacatttcgagaaagcttggtccttgtggttgtgtgttttcattcatggacatttgatacatccccctgcaggtggagagctaaattaatatcacaatataaagatagtgaaaaaatgaaacacattatttacgaaccaatgttgaatgttggagctccttggcactaatcattcatacccgttgaaaacatgggcatgttaacttgaggtacacctgcgaaaataagaaaatatgtgcgtggctcagtaaattacaaaatgatgaacattaaaatgtgtgtttattgaactaccggaaaacgatacttggaactgagagcttccagcttctgtatgcatggggggaaccatttggctggatcctgtgaaccacgcaaaccctccctgccattgaccagtggtatttgcatggggaatagaagggatcacagctgtactacctgcaataatctctgtaggtgaacattgaattcaaaaatatcaccaattttgttaacaaaacaaaacgcagaaccatcacataattttagtaaattcgaaaaatgagtccatataaatagtgtgtctagtactttgaagtccatagattaaattagcattgggtacagcaattaattctataagttaggccacttgtacttgttgatgcgaaaaacacacagtggcctggaagatctgcttaactttagtgcaggtccaaaaatctttcctttaggttcgtgagcgtgccagttgatttgatcctgcaatcaacaagaaataaatacaaagaaaccgcgattaaatccataaatgatagccgatcggccagtcgccgatgacatatcatttatctctgagccgatgtcatatttgaatcgatcggcagtcataaataaacaagaaagaactaaatctactcgatcggctgtagatattaacggtatataatacttctgtcgatatatacttaaatcaagtgattgggatagatcggtcgccatgccgagacagtataaatcacttagatcgaaatatacattaacaaggagattataagcattcatagcatagccgataagatagatctagcatgtatcggctaatactccgataccactctatattaagatattaaggcaagcaaaatataccaaacaagaagcttaatatacctaaatgtgatgagatcttaacataagatttaacatatcaatcaagcatatgggatataaagtagttaaatcaggtaagattggctgaaaccctgatgaaaccctaatcggcagccaaaagcaggctagagattgagattctaatcacgacttatatggtcaaactcaactgatgcagctataagtatgaaaagaataacaatatctagacaatcatgccgttggatatttcatagggtggtggataccctatataatctaagtcaacgttgatatttaacttaatcggctgccctccagtgatagacgttagccgactgagggttaaatagcaatattgccagagattatataggatatatgataaatcgacaacttgcataaacaagattagaatgtcataaagatgtaagcactaatcccgagaacgcaagccgccatgacaagtttacctctagttgaagatcgaaacgatgcagctcaactcgaaagtaagaaatcgtcgagatgaaacgaaagtaaaaagggtggcgatgcgccgagattgtatagaacgtgtgttatttgattacatgggttcgggtcatatttatacccgagatacaagatatgtccttgtcggacatgactcttatctctaataaactctaagataccataagtctttacggcagacttttgcccaaacttatctctaaggaaattacataaaatatcctaattaatagatacaattgccatttttaggactcaatccatgtgtggcaatccatatgaagcacattagctcaacccgacgatgtgtatcgagtcacattgtcgaaatcggctcaatcggctaccttgtccgactcaaactctactgacctggtcgcagccgattcggacttcagccgattcttgctctatttccggaacgatctatctcttggattccgcttcgattttatcttaatctccgatactttgaattaccaaatttgatcattaacacatgacccccaagtccggaatatttggtaatgtttcggatttgccatatctgatccccaagaaaatcacatattgccgtttttccgaccgttatcgctccgctttaaatactaaccgtcacccccgagaaacttcacaccgttacttccgttttcaccgccgaagcgattctatcttctctctctccggcgatcccctcggcgaagaaaggcgatctccacagcgattctagctccggcaaacttccgctcgcaacgatgtcgtcctccgctggtccatccgccgctccatcggctgagtacgctgaggtaaattgtaagattttcctttggctagcattcagagacaggctaaacaccaaagccaatatggtcagcaaaaaatggaatgaagatccccactgctccctttgcctgacactagaatcagctgatcacatactcctaagatgcaaaaatgccaataatctatgggaaaaactaaacttattgcagctagacaacaactcagaatcaagcacggctttccttcaagcaatcatagacagcaatcggtcttcaaaaggaatagaaccaatttggttcgctgcttgcacctacacgctatggaaatcccgcaacaacagagtgtttgaaggtcagtttgacaacctacagcacatcacacagcaagtctcagacacccttgatctttggagcatgagaaccaatgaatcaaacatgcagaaaattcaatcctggtgtaccaggctctcctagtataagaacccttgtttatatctttgtaaatcccaccccccgttctcttttctttttatttttgtttcttctcttcttccttttcgtttttttcctttctgttctaggttaactataacctctaacttgtaacctgaaaacctcatttctattaatgaaatgatctattaatgaaatgattataaggtggagcgcgctctaccttcttccgtaaaaaaaaatcgccgtccttctcatcgcatcgtatgccgaaccaactaacgcatcccacggcaacaagcaaacagtataaatccaactattcctatccgacgtttttgctgcctcaaactttactcaggctgtgttcggtacccttagttaccaacatctctctctcgtgttccgcgcgcatgcttttcaaactgttaaacggtgtgttttttttcaaaaagtttctatacgaaagttgtttgaaaaaaatcatattaatcttgtcagggttatggataccatatatctaataatagttgactaaatctcgacaggacccgtcacataccatgtcttatacggaatctgacctcggatatggatgaagttccggataagaaaagacaaccagagttctacatggaaacgacaaggactactcggattgtattcatattggtttccttagttctacttggacaaggtgacacctatgagtataaatacaagaccccctaggaggagaggggatatagagacaatcaacatacacggacaacatagacgccataaaaccacaagcctacatacgccaagacaagccgccggatatcgacttcagcgataagcacggctagtcccctacggtgtcttcggatactgtcaggagagacgaaagcgctatctctgatctcgccgggcacggattcgaggagaaaggctactctgttgtcgactacgagtcagatcttcagaccgccatgtcgacaacagttagataggctactccaaacattgtactggtgtggttatgatgaataagatcaataaccggctttggccaacaggatgtagggctattacttgtcagataaggggcccgaacttgtataaaaatccccgtctccatctcttttatctcagtctcgcgtatatcctagtaccaacgatccccgtaccatgcaaataccggaatcgcgacatcaaacgtcgacaatggcgcgctaggtagggggagtttggtacttcaaggtttcgacgagatgggttcaaaagatggattctctgacaacaagctattcgacgacttcgctgtgggaagatccaacccgaccgaagtatgtctcccgacgagatcggaaccatcgtcatcaacaactcgatctctcgagatcgaccaaacctcaagatacgcggcgtaccaaaagacgtcagatcatatgatgtcaaacaagtacgcggtaagagtaattggtagattggttttttaaattaatctactaatttcgtagatacatccggcatgtatctacaaaggtacgcaatattttatatgcaatttatcatacctattcagatcatacagaattgtcagatctataatttattatgtttacctagagcatgtcttttatacaatatctattgcacgagtatttccgacgttaaaccgactacggtctaacgctgggggcttgctctgttctcttctgtatgaatcatgcttgtttacggtttacgtaatgcctgatatttacatctgctcgtagcatcctgataatactagaagatccatgtagttctttgagtacctactcgatattctctgctatatatcttgccttctagaaagtatttttcaggaacaattgagcacttgagtaggatgtggtcgagtacactgcattatcaagaacgttcttgacaaatgcagagtcgtcgcgcccaaccaaccaacgaagaccgacgacctatctcatacaccggccatggctggactactcgagaaaaggttgttaacggataattgctcacgaacaatgtcggcttgatcacccgacatgatcgcggacagacatccggatatgctacgagttgggtatgtaagtcatgctggccacatgagatacacatgtaataaaccaactctagcgcctccattggtgttcgagagataattctactcgctggttctcgaatcagtaaaatcgtagcaatctctcacaccgcgacttccattggtgttcgagagataattctactcgctcgctggttcttgaaccagtagactgtagcaatctctcacaccgcaacttccattggtgctcgagagataattctactcgctgattctctaaccagtacagcaccgcaagtatgtactatgtttagagttacatgagtggagataagacaatgacaggtttcactgtgtggcaagttggcaataaccatgcttgttgttttactgtatttttttcctcccataataaagtaaagtaggattcctgttcaccgacccggcaaaaaaataattactgctacatgagtcatgagtggaaacaatgacagatttctactagcacaggcagtcagagactgtaagcatgcgcagattggtaatggccaaaattccatcaaccctttgtttcagctcaagatgacaaaactaatttgaagcaaacattcctgattccatgtagcaaacattcccttgtgaatcgaatcgatgatcctcttgataggacataaagatttactggagcttgctgaaaaaccctactgcttgtactgaagtgcaagctactgcttccaataaaatgacagattggagatttacccactatactactctgttgataattttgacagatcaccggcatagcatttacccaaaacaagtacaatgcagaaggggggggggatcggttgtattataatacaactggaaatatataacaagggcaaaaatattgtgctcccaagtttatcgtgtgaatatttatctgaaaaatttctagctactaactagatacaagaggtttcatagttgtgagcattatacaatacggaatacaaattccaagcacacctccggggggacaaaagtagtctatacattctgtcgaaaccgtaatccaggagtactagatatacttacacgagtagttatgtagtaacagcaagcgacagtaaagtaataaccccacccctcactgcagaggactggatatgagaagtaatgtactagtaacagcaagctacagtactagcccaaccctcactcaacgagatcatctgaagcgtttgagagaaatgtactccagagaaaacatatgaattgtgagcagcagaaaaactattaccagacagttaagactgagtttgtcacattcgtcgattaccagaaatgggtgtttcacttgccaccaggagatatgaccggttcacttggtgaaaagctcatctagacgcaagcagaaaagggcaagcagtccttcgtcccacattgctctcattaagccaggaagcgacatgggtagatattggtaaagcagcatgtcaacatcatttgcagaataccatttgaatcgttcagtcctttttgtgagatgatgaatcttgtggcatgagtagttccgacggtatctgcactgctcagagtttctgtctccataggatgtaaactgactgtggagcatccaccaaaggtacgggtgttgctctagacgtaccttccagtgaccacttgaatcattcatcccatagggtagcatcttgaacacttcgaacacagattgaagtgatgccctcatcaatgtttcatagcatgccatgaaaaactgtgagtgcagtttcagtgcaagcaaagcagggtggtttctcatcagataagcctcctcaaggatgggattttctaacatctgcagtaagtcctgaaaatcctcaattaagatatcccacgaacttggtgttcccagcgatgcattaactatctccttgaaaatctgtcctgcttggatataattcattctcattccttcacatgtagcattccttgtgccgcaaactaacttgaaccttggtttgaattccggggtctggtaattgcagaatattttcagatctttcagactgaactctgtaagttccagattcgcagaatgatgactgctgatggtctccagcacccctctcatagctggtttagcccattctgttaatatcactctatcaaacatggagtcgggcgcatctattggatgatgaaactccactgcgggatgctttctgaagaagaacaagggctcatagcatgtttctagagaatgtttatccctatacctgcagacaaagggaacaaaccatatgaatcaacaagcaaaagcatttcctatcattttgcatttcattgggtagtcgatggtgttcccagtgtaaaattcaatgatgctgatgtttggcacatatatggtatactgtatattttagctgaaataagacatgtctagtttgcttctaaaaatttttttagctgaaatatatatatatatcagggttgcatctctactgactgcacaacactgcacctgcatgcccagctctgcttcgcaactcagagtagtcatgaacttgttttttttttcacattttactatttagaggacataaaaaactatggggttcaaatttgttttttcacatttcactaattggaggacatacagaattatggggttcaagaaaaaattatgggcaccacttaatgaaaaactataaaattatgggcactacttaatgaaaaactataaaattatcggcgccacttaatgaaaaaactctctccacgaagcagggtaaattttgcttttggagacttactgtactgttggatccagcgcgtgcagataagcggctgtatcctgcggagaagttggcggagaaaagcaatctgacatctcgtcgagtacgggcggaggaggggtagtcgacggtggaactgcatcgtcagtctcaaactctcaatcggtgaggtaggagacgaagtctcgccggttttcatcgtgtgcagggaaggaggcgtcgccgcggtagatgatgctcccgttccgaaccaccgagacgccgtccttcctgtccacgggctcccggcagacctcgaaggggggcttgaacgaacggtgggaacgatcgcggcggacgtagcgggagcaacgctccgaggagggagatggggcaccgtagtggagaatgcgaactgaggaggcagcgcacgaaccgccgacgacgaagacgaccaccctagccatggccggaaaaactcctgtagatgagaacgtattagcgcggaaacaaacgacggggagaactagacgtggatgacggcgatacctgcaccggcgcgacgatggagcgacgccccgccggcgccgacaccgcggcggcgagaaccctcgccaacctcgccgccttccgcatttcgcgctgatgaactgatgattttggtttggggattcctgagatggaacggggggtttgtggggtgatcgttttttttttttttttggtattctgtaaggggggggggggggggggggtttggggtttgcgaggtgggctgttaaatctctcgtataaaattaaacttcaaaaataggaagcactccaaaaaaaatattaggctaagttctgaagtgctctactactatttgattgagatttccaattcacgtaaaacaaaacaaaagtagtcattaacacacaattaattaagatttagaacttaaaaatgtgtttgatttttttttagaaacttgtacttaaaaacacattgtttaaatagtttgtaaacgtgctcatggttaacgccttaatgaaaaagtggtccaatccaaactcactttcgaatctagcccaacattgagttcttaacggagttttggctaaaagaaatcactcgtttaatgtgatcacgctttccatactattaaatagtgtatttcgtctaaaaattttctatataaaaatatctttatcaaatagttaaatgaatttaattcttaaattgataggaatagtaattaacactcgattagtcatttgctaatcgctccgcttgtttgacatgccaccgaaaacataagataaattgcctaatggagctaggcctaagattgtactagtatttgactaaggctgtgtttagttccgaagtttggggagaagtttggtagtttggaaaaaaaaaagttaggagtttatgtgagtaggaaagttttggatgtaatgtgatgtgatgtgatggaaagtttggagtttgggggaagtttggtgtgaactaaacagggcctaaaaaggacttgagaatctatcttgtgactcttgtcatcgttggtggaccttcatgaattgatttgtcgagtagccacgtgagaaagttgtcgatgccgaccaagtagcagcccgaggccccttagccgggcctgcgggtgtagtccgcgacgctggcagaggaggcgccgcgatagaggccattgccttcgttggtggaatccatggatttgttagtggcgctcgatcctccacctctacggcatcggaggcgagggtttccgtcgacagccagtgacgccacaccgccaacgcgttgaaggtgagggttttaggcgacgtcctccacgacagctgaggaggaggggaaactggcctcgcggtgagagtggggcacgccgtcggcggagcgcgaagccaactgcgccgtcaccgcgtcgacaacgaggttgagcattctaggtgccgcgagtgtcggcggcgtcgccgactttggacctcgaagatgacgcacgaggttggcgacgacggacgccgtcttcggcagcaggattgacgcgcagatccagccgccccacccctctgccgcgtcggcggcgaccttccacatttatccggtggctccgatcggcgccacgctggtggtgcggttttttttcttcgggtttaacggaggggggttttgggtatttaatttttttgccactttgaagatttggctatctatgacatgtgggtcattacatgtctatgacatgtggaccccgtggtaaattcttagttactttggtaaattagttaattattattccttggtgggtcccatgtatcaaacgtgtaacgtggacccgagactctattcgtaacgtgccagattgacatgaacgtgacaacgtgtcacgaatttttactcttcctcccccattctcgcatcgtccaatctctccaccccccccccccccccgcaccccccaaaccctaaccgcctctccccccgccgcgccgtcgccatggacgccatcgacgcggagctcgcgcgggcgcaggaggagcgcaagaagatggaggaggcccttgccgccggcgcgcccatggccgtctcctccgtcaccttcgacaccgatctctacggcggcggcggctccgaccccaaccgcttcgccggctacgacacctccatccccgcctccgaggacgacgcgcccgaggacgactccgaggcggccgtcaaccccgccgcccgccgcctcgcctcctacaccggccacgccgtcgccgccgccgacatcccccgcgccgccgaggacgacggcctccccaagaagtcgcagcgcatcatcgaccgcgaggatgactatcgccgccgccggctggcccgcatcatctcgccggagcgccatgatcccttcgccgccggtgaggccaccccggacccttccgtgcggacctatgccgatgccatgcgcgagaatgacctgcagaagcagaaggagcagctgctgcgtgacatagctcagaagaagaaggaagaggaggagaaggccaaggagaagaaggccgtgcccgagcagcagccagtggcagcgccgaagcgccgcaatagatgggatcagtcgcaggatggtgatgcttctgctgctgctggatccaagaaggcgaagacctcctccgattgggatgctcctgatgcaactcctgggattgggcgctgggatgccacccctggtcgtgtcggggatgcgacaccgtcggtgagaaggaatcgttgggatgagacaccaactcctgggaggatggccgatgcggatgcaacacctgcagctggtggcattactccaggtgccacaccttctggagcttgggatgctactcctaagctgcctggtgggcttgtcacgccaacacccaagaagcagagatcgagatgggatgagactcctgcaagtatgggtagtgctacacctggaggcactggtgctgcgacgcctgcaggttacactcctggtccgacgccatttggtggtgacaaccttgcgacgccaacacccggccagattgcttctcgtggtccaatgactccagagcagtaccagctcttgcggtgggagcgggacattgaggagcggaacaggcctcttacggatgaggagcttgatactatgttcccgcaggaagggtacaagattcttgaacctccagcttcataccaacccatacgcacaccagcaagaaagctgctcgctacaccaacaccattgggcacaccattgtatgctattcctgaggagaatcgtgggcagcagtttgatgtgcccaaggagttgcctggtgggttgcccctcatgaagccagaggattaccagtactttggaacattgctgaatgaggaggaggaggagcagctatctccagaagagcagaaggagaggaagatcatgaagctcctgctcaaggtgaagaatggcacacccccacagcggaagacagcacttcgacaactgacagacaaagcaagggaatttggtgctggcccattgttcaacaagattctacccttgctcatgcagccaacacttgaggaccaggagcggcatcttctggtgaaggtcattgacagggtactgtataagctggatgagctagtccgtccgtttgtgcataagattcttgtggtcattgagccacttctgattgatgaggactactatgctcgtgttgagggccgggagattatctcaaatcttagcaaagctgctggtcttgctaccatgattgccgccatgagaccagatattgataacattgatgagtatgtgagaaataccactgctagagcatttagcgtggtggcttctgctttgggtatccctgctctcctgccattcttaaaggctgtctgtcagagtaagaagtcctggcaagctcggcacactggtatcaagattgttcagcagattgctattcttatgggctgcgctgttctgccacatctcaagtccctagttgagatcattgagcatggtcttagtgacgagaaccagaaagtgcggacaatcactgccctttctcttgctgcacttgctgaggctgctgcaccatatggtatagaaagttttgatactgttttgaagcctctgtggaagggtatcagatctcaccgtggaaaggttcttgctgccttcttgaaagctattggtttcatcatccctcttatggatgcgctgtatgccagttactacacgaaggaggtcatgcaaatcctgattagggagttccagtcaccagatgaagagatgaagaagattgtcctgaaggttgttaaacagtgtgtcagtacagagggtgtagaggctgattatatccggaatgacatccttcctgagtttttccgtcacttctgggttaggagaatggctctggaccgcaggaactataagcagcttgtggaaacaacggtagagatggcaaataaggttggagttgctgatattgttgggaggattgttgaggatctgaaagatgaaagcgagccttacaggagaatggtgatggaaacaattgagaaggttgtggctaatttgggtgcttcagatattgatgctcgtttggaggagctgcttattgatggcatcctgtatgctttccaagagcagacaagtgatgatgcaaatgtcatgcttaatggttttggagctgttgtcaatgcactgggacagagggtcaagccttaccttcctcagatttgtggtaccattaagtggcggttgaacaacaagagtgcaaaagttaggcaacaagctgctgatctgatctcgaggatagctattgtgatgaaacagtgtcaggaggagcagcttatgggtcatttgggtgttgtgctgtatgagtatttgggagaagagtaccctgaggtgttgggttcgattcttggagcattgaaagctattgtgaatgtcattggtatgactaagatgacaccgccaatcaaggatcttcttcctcggctgactcctatcttgaagaataggcatgagaaggtccaggagaactgcattgatctagttggtaggattgctgatcgtggagcagaatttgtgcctgctagggagtggatgaggatttgttttgagcttcttgaaatgttgaaggctcacaagaagggtattagaagagccaccgtgaacacatttggttatattgcgaaggctattgggccgcaggatgtgttggctactctgttgaataacttgaaggtgcaggaacggcaaaaccgtgtctgcacaactgtcgcaattgccattgttgctgaaacctgctcaccttttacggttctgcctgccctgatgaatgagtaccgagtcccagaactcaatgttcagaatggtgtcctgaagtctctctctttcctctttgagtatattggtgagatgggcaaggattacatatatgctgttactcccttgcttgaagatgctctaatggacagagatcttgttcaccggcaaactgctgcctctgctgtgaagcacatggctcttggtgttgctggcttgggctgtgaggatgctcttgtccatttgcttaactatgtctggccaaacatatttgagacatctccccatgtcatcaatgctgtcatggaggcgattgaggggatgagagttgctcttggtccagctgtgatcttgaattactgccttcaaggccttttccatccagcaaggaaagtacgtgaagtatattggaaaatctacaactcactatatattggtgcacaagatgcgcttgttgctgcttatcctgcactggatgacgatggggataatatctacagccgtccagagctggcgatgtttgtctgatcaatgtaagtgttgtttctttcctattattttgcttaaattttgtggcatatattattgaaacttctgctgttagttacgaagtaagttgtgatattgtatcatgggttcatatttgttcattcaggtgctttctttttctaaagagcaaccattgcattactcgtatgtatgattccttttggtttactgctgtccttgcaagtgttttatcagtttgtactgttcctcaacaaatgggcatccttagcctgggctactgtatgttattaggccttaggcagtttgacctgttggaataatgttaacttgaaacaacttagaaaaatagagctcagctttttataactcactttacatttacattgatatgttagaattctatggtcttcttggttacttggtttcagtgaacatctatcacgagctgcctatattgaatggactaggttgcaccaacagctattttgttcggtttgctccttttcagtggtgccaaagccttggttattgttatcatatgacccatagtgtgcaggcactagttcgtttttcctttcatgtttctttctgcaaatttgctttatgttctgcctttttcttccctctatgcaaagaacacatctgatgtgagaacgcattggcaggcaggatgtacatttccatgtaccgtcatccaatatatgcgtgtgaactgtgaagcttgaactcggtggtatttgagttagctgatattcaatttatggtgtttacttgtgatggatgcattttcattgaagttgcatttcttttttctttatttgcaggcttgttgcttctgaagggggtgcaatgtttaggatatatttccccctggtttacttgtgtaatgtaatgataaattgctacctgttctgatgtactgacgtttttgttactggttttgtgttcagggtattttgacccggtttgctgaggagttcccttagattaaagatcccaaggagatgatatctgtcctgaatgtttactttgttgccgttgcatgatcccctccgctctgaagagaaaatgatcaacatagtattactgctgtcccaataactgtattattagcaaaaaaatgttataagctactatcgagattgtgaacttgtcttattattagagtctgtattattaatgttattactatgcctggaacgtcacttatgtatgtctggaacgtggtattagtattactaccctgctctgagttgatggatcaatggatggatggttagatcgtatagtgtctgttttcttcccggactgttagttgttactttagaaaatgttttaaattgtattgcgtatgttgtggtttgtgatccatcagacaagctcctcatcagtcactagttacctaaagttgctttaaattctgtacctatctgagaacatgagttgtggatgtcgaacttatatttgatagtacagaacacgaattttgcttgaacattgcaacacttgtgaattttgcctggagaggtggtacaaaatgctcaggaatcattccatattcccatccaacccaacgcccatcagtagacgacgacgtcgacgcaaacgcccacagatacgaggcacaaaatcgtttctctccgcgtcgcgcacacgccacgcaagaggaccaggtcggtccggtgcgcgtgcacggtgcaccacacccacacccgtgtcggacgcgacggctcaaccgctttgacccacctgtcagtcagagccaccaaggcccgacccaggctacagagcccacctctcctcctccgtccggttcgcgccgcgctcccttcgttcgtgcgcttcctcggtcgccggcgatggcgatggcgatggcgccggcggtggtctcgggcgagaggctcgtcgtgttcctcttcgtcgcccgcgtcgcgctcgcggcgccggcccagctcgccgccccgctcgcggtcctcgccgcggccgccctcgccgtcgagctcgccgtggatggctccgcctccgcgtcctcatcgccgctccgccggttcaggaccaggtgcgacgttatatcctcccccccgctcttatccgtatcttcttccgccgcatctccacggagctgggctgctagttcgcgcgatttggttagctcgggggattgcgcgatcttgataccagtgttcgagtttcaaactccacgaattaagtgttcgaggagctccctgtgatgtcagggaacctgcgaggtgcagtgttttgcaaaattcgttggcgcagccgtagaatctgaggcgaattgatccatttgttggttcagtgctggctgcctccctgtgaggatcatgcaattggggaaacgacatcagtcggattcagcattccgcaggaatgcgattttacttgtacttgaggcttactgaattttcttttggttcagtagtgtgtaaaatggtcaggttttggtggttccaagaatccaagggacaaatatcactcttgaataattgggtttcagcatttcttagttgacccatttcacaaatggtaaattcagaggtgcttctatcatacagccagtcaaaatattgctctcattttgatggccaaaataatgttccattgcattttcagctaaaacgttgctcccactgtcatttatatgggttcttttatgcaatgacaattcaggtggggaatctctcccccccccccccccccccccggtgagttagtcaaaaaatttatatgggttctgtgatgtgcaatcctagttgcttactgtaagattttatcacgtcttgtgttgtgaggacttcaccttcttgtggtggcttgatgctcttgtgcatgtttctgtaaaagattgttaagtgcttgatgatgatatatgtatatgctccaggccgggtgcttcatcaggcatacttcttggtgccactactctgcctagtgtcatgctttcacggttaattcaactttatagggtcttactagcagatcctaatggacgtgaaggtatccatttttctattttgtcaaatttatcagatccactgctaaatggaaatttccctaaatcttcatcaacatttcaaatcttgtttgacactaagattttcggtgacgcatctggtttactaactacatatgtgttcattgtcagaatatgcataccttgaaatgcagtactgggcagtatctgttagctgccttggcatgttatcattttttgtttggcatctacggcagtctcccagcaatggaaattctatagcttcgaaatacggcttgttgctcatcattttatatcccctggcatacttgttccaccttttactgaagactgatggaggtacatgcatattttatctgcatgcaaacataatctcaccctttctttccaaaatctggtggaagttcatcagaagcaaggaattacaaactaatctaggttgtcttaacaggtctgctggtgatgagtaatttggtgtatttgctgtgtcatggagtggctgctgtgatcttaatccagcatattctagagaagttcccttcatgttcatcttttggtttgtacctgaagtctaagatgtagttagatctttatttttttgtttatatctgactgcatatgtttagactttagagctatccatacgattgctagttatcctaccagttttccatgcaggcatagtgcattatatctacactgttcattttttaaaatttaaattcagctaatttgtgtggttcctattggccgatgcaatgtatatgtctccttttcatcatgacttgaagctattgctttttttaacttatctttacattttctgtgaacttaggggaggccattttggtctcaagtggtcttgttctttactgtggtgatatgctggctcatactctttcaaaggtgtgatttattcctcgaactatgttttaccagcaaaatggtagcaaatctgatacttattttgttgcctgcacatttgcaaccgtgctgctggcagatggagttctccgtatcatcagaagcatttattcgcgcacctggaactcgaagcgagataggcacagttattcaggtagaagctattgcgttctctggcttcagtttcttagtgcataatacccttcccttttttttcttttctgcagggggttttgcttggtctttttcttctccccttgttatacaaaagctcccttcaagttttggcttactgtagaaaactggagagtcaaagaacacaaacagttgaggaatgcacacagaagagaattgactgtggtgtattttatgtttcattgttggtagcactattgttgttagtgccatcatggacgcgtcttattcaaggttttgaagtgcatccatttgtttggtgagcatataagtttgcatttcattggaagggcataaaagcatgcactctgttagtcaaatattgaaaaatttcttcctgtgttgcttctaaaccttgtgcatttttgtacgtattgaattttggttcacttaatggtttatattcacagggtttttaactatattttcaccgattcacgtgaacggcttgctttatgcgcatactggatatttgtgatatatgtatcaattagaaggttctacagtatatcaaaacaaagcaaaacggagaggattcttttgcgcaagtattaccatctcgttgctgtcctaattttctctcctgcagtaatatttcaggtaatatatgttttcgatattcgatccccatcagattgtttgaaacacactctcaataaattgtttctctttgcagcctgatttcttggacttagcatttggtgcagcatttgccgttttcttaatattggagatggttcgagtaagcattttctttatttgtgtccctttcttttcccccctctttctgttttttggcagtttgtatgcccacatgtgctaatttctccgacgaaatgtttcactctgacctcaggtttgggaaatataccctcttgggcatattgtgcatcagttcatgagtgccttcactgatcatcgcgattcggaaattctaattgttaggtaggtctggattaatggtcgttgttttccagattttaactcatttacatgttcagtgcttggataggcctaatactatatttgttttgttcagtcatttctcactcttgctgggatgtgcacttcctaaatggatgtcatcaggattcaatgaccgacctcttacaccatttgctggaattctcagcttgggtattggtgataccatggtaggttctatgtccagtgcgtgatcagttaatattttcttatgttagctgcgttcagtatgatgaattctcttgttttacctaggcatcaatgataggttataagtatggtgtcctaagatggagcaagacaggaagtgagtttaatttccattattatttattccatgattgataattgatctcttatgcacatacttttgaaatgttagagaaaacaattgagggcacagcagcaggcataacttctgtattagcagcctgctcaatcctgctgtcactcttagcttcaagtggatacatactttcacaggttttacttccccccctggcattaaaccatttgaagcttttattctacaatatactaagcaagcataaatcctgaccatctcttttatattaacacagcattggatatcacttttggtagctgtgacattgagcggtttattggaagcatatacagcccaactcgacaacgctttcataccccttgtcttctatagcctcctatgtctataggagcaaccaattgtacatcaaactaccttgaggccctattcttaccattactaatatctagtgactagtgcagtacagtataggtatagcccttcgaattttttttttaaatcctcttattggtcgcattctctgtattcctggaccgagaaattgtgtccattactaaaaagttgagtttaggtttaggaaataaagatgaaaatatgaaaggttgtttagtgaatccttcagtagagagcatctttggtatgatagacttctgagcctatctggaggcatcaatgtatcatggaaggtatgttgtctttcagaaccagaacttcttctgcaggtggtgagacctatttcaccccacaactccacaagcagttgggcaagaatagcaagctgagagtaaagccatatgctgcaaggagcctgaaatacggagacttggttcagaattaatgtatatggtaccttatttccatggacatgcgaagtgtaattagttgtagtagctaatctcctgtaagttttgcgtcatcactgtacggagtaaaagatcactactcagattgcaaccgcgcattgatgtaaattttgttcttgacctgagaaaaaatgaaatcgaagtaagcaaagctgcaaattaatgttctcttattgtgagattggcaggtttgcgatgtttgagttgtttgtgtgatctgtttatctatcaggatacctccacctgccgacttgctgtgtcaagttcagtcagatgatccttgcctaattgtctaattgaacaaaagttcagtcagtagtctttaatatggtattctaagtagtttttttttcaaatcaagctgatgaaaataatccatgtccttaatatggtattctaatgtcagaatgcataggccaaaatgaattcaattatcttaacatgaacttctatgatccaagccccatgtcggttgcgttgagctgtccgcgttggaactcgcaacgcacccatgctccatgttcttgcgcgattgctgtcgtgccgactaattaattacttgcccgcaacgcaacatgacatactgcaactctgctcaagttcacatccggtccatccaaaaagtactgaattttgcatagtttccttcttttccttttctcaccgtgtcaaacaacaccaccttgttacccaaggaaaccccgggagtcatcgtcgcaatcacagaaacttcacagaaaacagtaagtattcaattcaagtacgtctagaccaaaaacacaacgaaacctaatcaaactccagccgaatttcgcagaatttcgaaccacctttggcaaccaaccatcccacaaacacacacagaaaggaaatgtccatacgtactaaaatttccttacaaaatacttatagactatgatgtgatgagctctaagtaaatctagatctcttgtaactttcatccatctaattaaattaaacggttataaaaaatttgttagtatgacttttgtaaaaaaaattaggctgtgttcttccccccattttccgaacccacctctttcgttttccgcgcgtacgcttttcaaactgctaaacggtgtgacatatgcaaaaactttctatatgaaagttgttttaaaaaaaatcatattaatctattttttaaaaaaatagttaatacttaattaatcatgcaataatacaagtttcgttttgcgtcctcccgaacacaccttagtacgttatctctctaattgctacattttaggatgagggtggtgtaactgtgcttataatttttttttaaaaaaaggaaaggcccacacggacactaggcccaaggcaagcccaccactcgtgctcgtaacggaacggaacggaagcaaaccctaccccccgtcttactcatactccacactccacagtagcagccggcccgtagaacggaacggaacgggaagggggagacgagacgaggagaagagaagagagaagaggtcgagccgcgctccgcctccgtcgggtcccctttataacctctctctctctttctctctctctcctcccaaaccctcaatcgtcgcatcgcctcctcctcctctcgccgctcgcagcgaaaaagccagcgcctcccagcgcccacgcgatcccgacgaatcgaatcgagtccgagacgccgatctcggattcgagaccgttgatttcaaccaacacaagccctcctccggatcgatccgctcctcttcaggtaacaatgaacgatgggatgggatgggatcccgctgaggatgcttttttttttctgttttgtttgtgctcgatctggattcgggttggtccggcttggcgctggctcgatctgggtgtcgccgggtggtgggggcgtggatctgggttggttcgatgtgattttggcgagtctgtgagagagaggggtttgggtgggagatgcgtgactttgattgctttaatgatgtttagattgttatatctccgttggcatgtttgttatccttttgagcagctatagaagtggtatgtggtgcttgacaatagtaattgatgttttgggtgtcctagtgtttgcaaatctaaaatttgtaacatgctagtatatgtacttttttttaatgactgcgttagattatttgtcctgctaagcacttcgatgtcctgctttgtactttgatgactgttagattattatcctttgtatgccaaggacagtggaggaaccataggaagtcgaaggtctttatggaccaaacgaaggtcttttttgggccaactagtttggtctgttcgcttattgagtatgctgtgttaggaggattccttagattaagctccacatgcagtatccattgtatactgagcttgatctctaacctgttaggtcgattaagtaaattctggactgttgcgagtttgtgtttcccggttcgaagatttcatgttgtgtgttgtgcataaaccctgttcgaagagatcatgttgtgtcgtgcatagacttcaactatgggtgctatgttccttgtgtgcagcagaaagctataaatgtactaacatttattgtgcgggtcaagactgcttttacaactgagtttactactactttgtgtccttcaaacattattgccattcatcctttgtaacctgctcttttttttcccttgaatacagccatggcaggaatggcacccgaaggctcccagtttgatgctaagcactatgacagcaagatgcaggaactactgtaagccatcgttctattctaccgtatttgtaatcttagtagcagctaatggatgtttgatttctcatttgcaccactcgttatgctatatgggtttcattatggactttgtgtctctcgcaacatgcaggcaccaaggtgacaatgaggaattcttcacttcatatgatgaagtttttgagagttttgatgacatgggcctccaagagaaccttctcagaggcatctatgcttatggtatacaaaaagtcttatcccttttccattgtttcaacaacacatattttggtgatgttacaaatccctgtactttgatgtgtaggttttgagaagccatcagctattcagcaaagggggattgttcccttctgcaaagggcttgatgtgattcagcaggctcaatctggaacaggaaaaactgctaccttctgttctgggatcctgcagcaacttgactatggattggtggagtgccaatccctggtccttgcaccaacacgtgagcttgcccagcaaattgaaaaggtcatgcgtgctcttggtgactacttaggtgtcaaggtgcatgcctgtgttggtggaacctctgtccgtgaggaccaaaggattcttgctagtggtgtgcatgttgttgttggcacacctggacgtgtgtttgacatgctacgtcggcaatctctccgcccagaccacattaagatgtttgtgctggatgaagctgatgagatgctctcccgtggtttcaaggatcaggtttgcttctgaccagcccattattctgctataatacctccaacagtttgtatggctgatcttttacattatgtcttctgtagtgttcatgtttgtgtaattgtgttttaagagtgtttcaagcatcaaaatctgatataagtacaacatatttatggaattgttatctgagtgcgcgctatgcttatgtttatgacttaatgttactattcttgaagaaatcataggtgattactagtttgtaaagctggtagttcatttttaggactcttttaggacttacagtttctctctctctttttttttacttgctgaccttcacctgcttcattggctatctgttaacgcaacaatatgactgcatatttttaatacatgtactatgtgtgtctaatggttgatgagctattatggaagttgtatttcatttctttatgctgtagtgttgcatggtctgaacttacatatggtgttcccttttcagatctatgatatcttccagctccttccaccaaagatccaggtcggagtgttctctgctaccatgcctcctgaggcccttgagatcacccgcaagttcatgaacaagcccgtgaggattcttgtgaagagagatgagcttacccttgagggtatcaagcaattctacgtcaatgtggagaaggaagattggaagctcgacactctttgtgacttgtatgagacactggccatcacccagagtgtcatctttgtgaacacccgccgcaaggtggactggctcaccgacaagatgaggagcagggaccacactgtctctgccacacatggagacatggaccagaacactagggacatcatcatgagggagttccgatctggttcttcccgtgtgcttatcaccactgatctgcttgctcgtggtatcgatgtccagcaagtctcccttgtcatcaactacgacctgcccacccagcctgagaactacctccatcgcattggtcgtagtggtcggtttggcaggaagggagttgccattaactttgtcacccgcgatgatgagaggatgctgttcgacatccagaggttctacaatgtgaccatcgaggagctgccggccaacgtcgctgaccttctctagattatgtcttaggaagtaaggttctggataaaagtttgtttttgtttttgttttaatatgaccaactttctcgtttgggaggagtggtaaggacggggtctatttgaattgtggttaaggacggcttccatgtttttctcttttccgtatgcaactatgtttggaaatttttgtagctgttaggctgtgctgcttcctgggctagctgggagagggagacactactggaatatttactttctttattaagctatgcttgccttgtgttattattccaatctgctcttacattcttcagctgtttgcaatccgtacaaattttgttcttattggtaatgtgaaatctaacttgtttcgagaaaaagtttatgttcaacttatcaagaattctgctttatcagcatttggtggtgagaagatcttgtgcagttacacgttgtggatcaacctggtaaacattattgcagtactggttggctgtgtttttttggctgtctggtccaaccacagcaagatcacaatagcaaagcaagaccacagcaagatcacaatagcaaagcaaagcttgtgcatcagtaatggacgtttggtgagtactattacaaagcgaaagcgatgggcgttgattatgattttattgtgcttgctatccgattcagagcctcatcagcatcatcctgtcttttgcgccttttcctctctggactggagtcactggagtgatggcatggggcatcttattcctccacttgctacacaaaagagctagtactatctttgatagggacactggactggagaacaactctatgtgcctggagaacaactctcctataggctgtgtttagttcagcgcgcaaagtttggatttttattgaaattggaaataatgtgactgaagagctgtgtgtgtatgacatgttgatgtgatggaaaaggactgaagtttggatccaaacttaactttagatctaaacacaacctgtaaattactacactgataggagcactatatcatacagcccttgacgccaacaaaataaagtactgtccatatatatatatatatatatatatatatatatatatatatatatatatatatatattccaatttgtgttctctgacctcctcgatcaaaaagctttctataacaccgaaaggtgaactttcaattgtcatttttgcttttataaccctgaaaagtagaacattcaaggtcatcttttggctaatttgttagacaatggaagctttttaattgaactccccaattacattgaaacgatacaattgtactaacactttcgatctctacatagcaaggatatacatggccaaagcactctcacaccctctcgtttgaattcgatacatgaagttttaaaacttatcaatccgtagactagatcatcctgggtaaaaagttctctaactacattcttcaaaggcagacatgtcgcaagttccaaatcatgtgtacctggcttgagaagtactccctccgtcccacgatataagggattttcagtttttacttgtaacgtttgaccactcgtcttattcaaattatttttacaaatataaaaaacgaaaaattgtgcttaaagtactgtagataataaaataagtcacaaataaaataattaataatttcaaatttttttaataagacgagtggtcaaacgttgcaagcaaaaactcaaaatcacttatattatgggacagagggagtacaacgttttgataagtataaacagtagccttttgtccttttgtgggaaaagtattccccacatttttcgctaatacaagaagatgcacccacgtttgctatcacatcgtgcgttacgcacacataaatctccttgttgtttcagctagaaatttcaaccttcctattttattaatactactaagatagtattctgatttagtttttgtaatttgtaaaatcttcaacaaaaagttcttttgatttgaaaacttgaacttttgagttcagtttataatactaaaaccttgaggtagaaatgtgcagctttctatgtattagcactaggagacaatactaatgatttagtttgtgtaaccagtgatatattcaaactaaaaagctttcaactgaaaattgtcaactcctgagttcagccaatgtccaacttttggttcttctaaccaaagtttcaccatacacttttgtcaacccatatttttaccttggaccatatgaccctatattgtttgaatttcattgtggacctccttttctgttctcctgatgtcctcattaactgctctccttagtcctagcctcctaggtttcaagtatttcttaatcatatcgatttgtcaagggttggttgctttttccctatagaaccagcatcgaagtctcgaacttgctcatattttacctagattaaatgaaaggtttgaaaatatgtggctagtcctatcctatcctaattacatcggatggctagcttctcctaatcatctcagttttttttttcacactcagtcctcacaccaacactgcccctaaacatctccactgactcataaattatggccacgtggcgcgtgattttgagaagaggaggataatgggggtccaaagtgaaataagaaaaataaacacagacaaaaaaaaaaactaaacaaggcactaagaggaaaaatctgacaagccgaaactgaaattcactcgaaagacaaccagattggttctcccttttgggccactcgccacagaatgagcccatcaaagccgaagccttccctttcttggcccaccaggcccggcccacccgttcgcgaaaaaaatccaaggcccacagatccattcttggaggagggggcaaatcgagtcgaaacgaagccccccgtcgcctccgtcgcaagcaaaccggagatcccctttcccttctttgctcccaccaccgcctccacctcgcacacccagcggcggcggcggcgcccgcggatttctcgctcgcgcctccgaaaccctagctctcgcccgtagtagccatggcgccgcccgagaaccccaacggcgcgggccccgcggcgccgtccgaccccgcgcagccgcagccgcagccgccggccaagtccaagtggaagaagaaggacgagaagaaggatgacgatctggtgagtgtccccccgcgtccgttccccggcgcgcaacggccgatgggagggagatcgagattcggaacctcggtttttcgtttgctggattcgatccgtggttttgtgttgactgttttttttggtgggcagtcggaggaggatttggcgctcaaggagcagctcgagctctacgtggttcgggcgcaggacgcggatcccggcgtgcagaagctcgcgcttgagagtatgaggtgctgttcgcttgctgaaattaattaaccgattcttttttttagggtagggtagcgtcgcgtcgtttcctgaatcccagtaggaaatctaggtttagatttctggtctccaggcaaattttgtaaatgcagtggttcatagggtttattttgatccaccatagttagatttacttggttaagaccaaattttgttgctttgatttccatcttctgtcactaaaatatcatcctccctaaaaggcaggagattcgttccgccacaagctcaatgacatctgtaccaaagccactgaaattcctccggccacactatggaacactcaagtcttactttgaaaccatgccagaatcttctgatttgaaggtatattgtctgttgatttcccagttgtgcagtagcctaactttctctttgtcacagcgatgaatgctgatagtaatttcttactgtttttagaggtacatggccgacattttatcagtgttagctttgacaatgtccgctgaaggagaaagagtatgttcctgccacaataaaagctttttgtatctaatctgaacaagatatttctttgtttgaaacttcagtacttttcctaatgtttttttgcctattacttgtttcaggaaagccttaagtaccgtttgttgggctctgaaggtgatatcggttcatggggtcatgaatacgtaaggtaagggcaattttacatgtttttgacattcatattttgccttctaaagtggtatgatatgcttgtgccattattctaaagtgataatagtgttagttagctgtaacttgcatttgtgtcatgaactgtcacttcctactccacttatatttgaaaagtttttgttttttcattcttgattcttacttctgtccaagcatatgtttgaactccagagtccagacaatgtttctgtccgtgcttttattgggaatgtcaaagcgtgcctagtttatattttgaggtgccaaataattgagattgaactaaacagctttgtcaattattgttaactaatattcctgcgaccaatatactgagtaacttgtagaatcatgggacagaactaactttatgatagtcatagcactgtattgagttctaaactatacagttttgtttatgattaggaatgttttttttgaatcaatatgtcgattgtgactgaggttgtatcgttggaaccttttaattagtgtctttgacattttattttgcagtgacttatccctgatttatgtccaaattacctgaattttagctatatttgatattttaacagtgtattcaaactcaatatattatactaatgttttttttttgttttcattacatatttgggttctaatgaaatagctgtctcttgtacagaaatttggcaggcgaaattgcacaagaattccaaaagcgtcaggtaccactctcactttcatgttaatagaagctctgaaacttttacattttttttgttaccttgtatttatcttcccttcatgactttgttctgaagttgtgataaattgtttcttttgttatttggtgacttaattcactacttcctatcatggtccctttctgattccagctatttcaatagctacgtatttgttccttcttgtttttttgttaaagcttgttgacttttgaataacatgcccagagacttgcattgatgactgttggatagctgaaataagttatgaggttaccatgttaagaaaccgtcgtttattctttcttgccccctatgtgattctctcgccatgcatactatttgtccattttaattccatgatgcctgtaactaggacaacgtttctttaaatgttttgtttgagtggttggaacctttgattcaataattaattgtttcacaggatgatgacatgccgattgacgctcttatggaactagtgcagcaaattgtttcattccatatgaaggttggttgacttgattcttatcagagattttggttttggtatttaatttgatgctctgattgatgccacttagtagctgtagctgttgttatttgtttgacataattaatgcattaatggtgctttattgtaatttgtaatgcagcataatgctgaacctgaagcagttgatcttctgatggaggtattttcatatagtgtactaattaactcagattttattattaccacaatctgtctactgatggctatgctgatgcatgacatttcatctcctttgaaggtggaagatcttgatttgctagttgagcatgttgactctacgaactacaaaagaacttgcttgtaccttacaagttcatcgaagtatgtaaacacatttttgttttgttttttgcctccattatatgtctctttttccacgtgttgtatacttttttatgctgtagatcctgtggtcctaatctggcaagatttccttggagtagctgaattttgtactttagtgttaaatttcaattgaattgaattaatagctgcatctttgaatgtaaaaccacagatacctccctgctcctgatgacatgttggcgcttgacattgcttataccatttacatgaagtttgaagaccttacaagtgctttgcggattgctctgctccttgacaacaaggtgagctgcttgccatgctattcttctctttgtatgactgaattggaactgacgtacatctccatcgtttctagtcaatgcagtatgtgaagcaggtctacaccgcaactgaggatcttcagctcaaaaagcagttctcattcatcattgcacgccatgtataaatctctcacgcactatctaccttggttgccaccttttgcatcttatgctaaaagtagcaatcccttaaatttgacccaagcgcttctcttctgcagggtttggccatggagattgacgacgagatagctgccgatggcaatgataaggagggtttgcaagaaatcgttaataatagtaagctgagtgaggggtacctcacccttgctcgagatatcgaagtgatggaagcaaaatctccagaggatatatataaggtcatctatattttactatcaatgtttattaaggttgcttttttcattcataataattaatatttgtatttaacaatctacaggtccatttaattgatgggcgtggtgccagctccagtcttgattctgcaagacaaaatttagctgcaacatttgtaaatgcattcgtaaatgctggatttggtcaggttagctctacaaacaatatgttacttttagttctttccgaggaaagaatgaatctcaagaccatatcttctgtgcaggataagttgatgactgctccatctgattcttccagtagcggagcttctggaaactggttattcaagaacaaggaacatgggaaagccagcgcagcagctagcctggtaagttacattgttattgatatttgacaaactctacaaaccattgacaactgagttctttaactggtcaacaataataacaaaagtactgtttcaccttttcagggaatgattctcttgtgggatactgattctggacttgctcagcttgacaagtacttacatagtaatgatgctcatgttgttgctggagctttgctaggtattggtattgtcacatgtggtgtgaagaatgattgtgatccagtatgtgctccactgtctaagtttcccaacctccatcctactgattaatattgcaaatcttttcttaatacccaaaattttgcaaatactttctttaataccctaaatttgctgccaggcacttgctattctcatggagtacattaacaaggatgacacaaacattcggattggggcaatcttgggtcttggtattgcatatgcgggttctcagaaagaggaggtgggatttaagaattgttattctgtgcttttacaaaaaaaaacattttctatatgttccacataacctgctatctgaaatttcagcttaaatcttatctatcaactgtgttgggggactctgagaaatcaactcttgaggtcctgatattctccgccatcgctctgggattggtgtttgttggttcttgcaatgaagagattgctcaatctatcatatttgccttgatggagcgcagtgaggctgagctggcagaacccattatacgcctgcttcctgttgcgcttggtcttctgtatcttggaaagcaggtactttttgagcaaccttgaagcttagttccttttgattcattttttttgggctgtgtgcactagcatttgcttaaaaaaaatccagtattccctgcttttatacatttgaaatactgttcaatacctgtggattcgaggatttacctagtgtgtcctccctttattttattttaagcaagtgcttgtttctgttggttttgtcaagcgccttacctgctgtaaatgccatgtcatggttcccacatgatgtctgacctttcgcattgtaatgttgtccgtattgtttatatattgtatttctattcctaaatgtactgtatgcatatactatagctgcctttgtttctaactgttgtttatggctttatgcagcccttttagataaatgtaccttttatgattgtttggcaatttccatttcaggagagtgtagaggctacggcagaagtttctaaaacatttgatgagaagataagaaagtactgtgatgtaacacttatgtcactagcatatgctggaacaggaaatgtgctcaaggtacttcatgtttaatgcttagaggttcttgtggcttcaagcttgtttaaatttcgaggttttgatatgcttggcaattttacgcaggttcaaaagctccttgggatttgctcacagcatcttgagaaaggtgaaacccaccaggggccagctgtcctaggaattgcgcttattgcaatggctgaagaattaggagctgagatggctgtacggtcacttgagcgtcttttacagtatggcgagcagaatattagacgggcagttcctcttgctcttggcatactctgcatatctaatccgaaggtatgcaacatttgaccaacataagttttgttaaggatcacgatctaagttaaatttgaagtaatgctttgatgattaagtgtaaaaaaaactttgagagaggatgcagaatctaaactccagttcaatgaaagtgtgatcaattgttttatgtttgaaaagagtgttaaaaaaaggagttgtgctcaaattctcaattgacaccataacatttagtacattggaacaagtaatggagttattacttgaaagtgctaaactttgatgttccattattcaatatcttattccaagcaccttctttagctatttatttcagcgcttactgttctgtcaaattactcatattttgcaaggatattgtcatgcttattcggtattaagtgtttgtttgatggtccattctacatctatttggttgcataatttagcaaagcaatttatgccccactcagtgttgttgtatctacttacaattctattatcccatcccaggtaaatgttatggacacgcttagcagactgagtcatgatgcggatgctgatgtgtcaatggtttgtattcataactttttaacccacgacatacccaatatattttgtcctaattgatggcttacgttttatacctgaattaaatttctctaggctgcaatcatttcattgggtttcattggtgctggtacaaacaatgctagaatagctggtatgcttcgcaatctttcaagttactattacaaagaagctgcgcatctgttttgtgtaagttaataaatccacaatgatccttttaaacctgtgctccattctgttgtacctggttgtatataatgcgtacatatattgacaaaattttgcatgtattcaggtaagaattgctcaaggacttgttcaccttgggaagggtttgttgactctctctccataccattctgaccggtttctactttccccgtgagtatagctagtgctatttacatctactgtttattgcattcaatattaatccttcaattttttgtttgggtgtagaatggcccttggaggccttgttactgtattgcatgcttgcctcgatatgaaatccaccattctagggaaataccactacattctttacattatcgtcttggcgatgcaggtatggtccatttagttaattgacagttttgttgctagtgcaaactactatttggtactaaaattgagttctcttcttgtatgtacagcctagaatgcttttaacggtggatgaggatctaaagcccctatctgttccagtacgggttgggcaagctgttgatgtggttggtcaggctggaaggcccaagacaattactggtttccaaacacattcgacacccgtattgcttgcagcaggggaacgggctgaattagcaaccgaaaagtaataagagctcaattaacaatatgccatttctacaagtttccccatgaaacctaaaacctgatccgttgttttacgttttgcagatacattccgctgacttcggtattggagggctttgtaattctgaagaagaacccggaatataacgaggagtgagggacatttccaggcttgatacaatgctgatttctggggctcacaggcgtggcatactagggaaccatgctgcaacatgggacaggatctttgcctattgggttccctcctcggcgcctcctggtgttaatcggataggtcttttatctcttctaccggagtctcgagtgttggagcagagctctttgaattctgaaatcctttttggttgtgcaatgactgacgtgacgtatcacttgtacccaaacatgggcatctaggagttgaactgtttccttttacctccagtttatttatctgtatgtagcaaagtatgtactggaaatttgaggtcgaagtattattcttgatttccacaagatctcatcaaggaagctgacatattggtttcatgcttatctgttatggcagctgccatttgttttgttgtcactagtattagtttttggcacttagaccgccatctgatcagatgataagtatttcaggttataaatgtttatttttcaggtccttaacaatagaattgcatccttgaaatcattcgtctctactaacagagtttacatagctatgcaatgcatagttttaaaactaaaaaactaaccgatgaatagttttaaaactaaaaaattaaccgatgaatatgtatgttttaaaactaaccgatgaatatgtatgtttatgtatcctgcataagagcaggattaatgaaataagggtttttattaggatagcactgagagcaaagtataatagtatagccaactataatatagtatcgattcatacaatagttatctataaatatatattacacttaatatatagtctcatctgtcatacatacattgtattttacttatatataaatatatactacactattaatatataaacccacttgttgtacatacattatgttctagagtccgtgttgcatctgacaataaatttatagcctgccactcctcttttatcttctcgactgcgtgcacgttttttaaactactaaacgatgtgtgctttgcaaaaattttctatataaaagttgttttaaaaaattatattaatatatttttcaataaataaataaatactaaacgatgtgtgctttgcaaaaattttctatataaaagttgttttaaaaattatattaatatatttttcaataaataaataaatactccctccatccctaaatgtttgacgtcgttgacttttttaaacatgtttgaccgttcatcttattcaaaaaatttaagtaattattaattattttcatatcatttgattcattgttaaataaacttttatgtatatatagttttatatatttcacaaaagtttttaaataaaataaaggatcaaacatgtttaaaaaagtcaacggcgtacatttagaaaagaagggaatacttaattaattactagtatgtgctaatgaatcactctctgtgctgaggaaacgagtttccaacacaaggaaacgaacgcactcgagtctactagtactactcgttagagtggataatcaggggtgtagtcttggccgaagttataacggcgcgacttgtgcttgacgacgcggagcttcccgccacggccgcgtaccacctccacgccggtgagcatggcgaaatttatttcacccctttctctgcgatcaacactgaacatcttggcgacgcacagcttgccgccgcccaggtggacgacctgcgatgcgtacacctccaactccctcctcctccggtcgtcgctgtggctctccaccgagaaccccttcacctggaggctcgccaccggcggctgcggctgctggaacgcggaggacagattccacgctccgagaatggtgccatccatgtcggagatgccgaaccagaggccgtgctcggggacgtgctcggcgcggccgcggaagggcagctcccagtcgccggccttgctccacgcggagctcgcggtgtcgaaggagtaggtgccgttggtcgtggtggatatcaggatgtgcgtgccgccgtcgccgtaggtcattgtaggtcgtggtggatatcaacacccgcttcttagcatgcagttaagccatggatatagaatcagcaactggtcgcaggcaacgtataggagggacgggtactgtcatagaactgaacctggatctaagtatttgatcgttcaaacgcacaggatatatcaccagtatttccctaggacactcccagctatgatgtggggaatggtggctctacgtcagcacaaggtgatagattttgacaggttattcaaatgaggggaacggctagccaggtaaaggtcagcagttcattcccctttcattatagtaggtcattgtgctctctgatctcctgtagtacatgaaacaagattttactaactgaaataccttttgctttgcttggtataggtatatcttgggagacaattgcatagcttctcgatgaaccaccctgttcctgttgctttgacagggacaacgtacagttgatgttcggttcacactcaacagtcctgttcctgttttctttgacaaggacaaagtacgggttgatgttccgttgacacagtagtcaattcgcagtatctgtactgcaggcatacaaattcgatgtcaaagccccatgctctgtggttacattgcctttgttagtacatctaccactgttcattttactaactgctagtaaaaacatctaatggtatcagattgtcagttttggaagaatgattacacagaattaagtttggtgttttgtttggtttatagccttagttaaaatatttctgtaagccaaatacgagcgttgcaaaatttgtgacgaagttaggtttgttgccaatttttcttggtaaaattgctttgagcattgtttaatttgagatcaattagagactaaacaatgtacactaccatttcattttctgttggcaacaaaccaaatgtgtttgccaaattgcattacccttgcaaaagaattgataagattcatatttgtgcatcaatccaaacaattactggatcaattcaacctcaagtttttttccctgcctttattcttcgggtcactctccggcccggtgcctctatcttagtcaggctttaggaaaactagataatgggtttgtcgatgcagcatgcatcgttaaacaacattgactcccatgatctgcacctgtggcgaaaacaagaccaaagaggcaaagattgtcgcatcaaatgcaaatttagagactttttctcccttcgttctaacatggtgagtcattcgcttgatctgaaaatatagcatagagcaaatctggttgaatgcaaatgtccacatgccatgggcacagttagctgacaagaagtgcctggcagacagtagataattacatgccattttcacatccatattcacaaagataatgcactggcaacagtatacactagactgcaagatgaactatacttcccataatcattttccatcatagtaagtaactacagacatagctgttacttgaacaatgacacaaatatgatacaatacacaaggataagaagagccttatagtgtctacgttgtttgacagaaacgtgaatgtgtaaatgaaatttgaaagaacattgtttgagtaattcagctgtcagacacgtaaaagttaacaacatccaatgatatggaagggcacgtactgcttgtatcagcacattctttagagagacctaccaaacctaatcaacaaatcaggaaacttcagattagaaaaattaaggtcgaaaagaagcatatgtgcaatgattggcatgatcacaacatcacactgcctatcagaactttataaatgacaatctccaactatgtagatttatttttctgcttgtgtgccttagatacaatagtttcagttatacacggtgtccatatcacagtccaacatcacgaaatgaccaattgaaaaggatatgtagtatctaattacaataccatgctgacaccaataggttcaaacatgaactgaaacgtcatattgatatgcatacttaatataaaaatttaacctctcctcaaaaaaatatatatataaatttaaccttattcctaacaatgttttgtgacttcaacaataaactgaggacttgagatggagatgaaaagacaaggaatcattatagactcacaggagatagtaccaggcaatattggcatgttgtacttggatctaacgcaatgtaactgaattatgaggaaagaattatgcagaggcattcattgaaataatgcatgtgatatactcattgaaaagtatattagagtaggatgcacagctaaacttgtaagttacaatggagcaaaagaaaacaaaccccaccttcaaagagccttgctaagatccatagtgtttcccaaagttatctagtatataacctttcttgaagttcactgactaactgtccttaaagaaaagactacattgatcaaggatttgtgccagacaaatttcagtatgactttcttcaagttataagtacatcgacaacagtgactaaatgttttggagtgccataatcaatagagagaaaaaaaaataattcactagagactattttcattttagtaccaatatgatttttgttaagggggtggagtgtatgttaacagtttttttgcccaatgatgatttaagcattgtgtttttctcatcgtcaatactacatgcatttatgcagcctgttaaaggaatgaaaattatagagagacgagctaacccgcatggccacatatgcatcatcaaggaagctgacatattgctttcaggcttatctgttatggcagctgccatttgttgtcactagtattagtttttggcacttagactgctatctgatcagatgataagtatttcaggttataaatgtttttttttcaggtccttaacaatagaattgcttccttgaaatcattcatctctactaacagagtttacagagctatgcaatgcagagttttaaaactaaccgatgaatatgtatcctgcataagagtaggattaatcaaataagggtttttattaggacagtactaagtaggagtactctactagttagagtagataatcaggggtgtagtcttcgccgaagttataacggcacgacttgtgcttgacgatgcggagctttccgccacggcagcgtaccacctccacgccagtgagcatagcgaaatttattttacccctttctctgcgattaacactgaacatcttggcgacgcacagcttgccgccgcccaggtggacgacttgcgatgtgtacacctccaactccctcctccggtcgtcgctgtggctctccacggagaaccccttcaactggaggctcgccaccggcggctgcggctgctggatcgtggaggacagattccacgcgccgagaatggtgtgatccatgtcggagatgccgaaccagaggccgtgctcggggacgtgctcggcttggccgcggaagggcagctcccagtcgccggccttgctccacgcggagctcgcggtgtcgaaggagtaggtgccgttggtcgtggtggataccaggatgcgcgtgccgccgtcgccgtcgccggccaccgcgtacccgcagatcatgccgcgggaggagccttcgaagccggcggcgtaggcgttcacgcacggggacggcggcggcggcggcggcggcaggggttgccagaggtagttgtcccctacctcccacttgtcggagtcggactcggcgggattatcctcgaggcgtacgagcgcctcgaagcagccggcgccgtcggggaggggcgtcgtctccatgacgtacaggtcgtcgccgacggcggccgagacgggcatgagcttgggcgccgcgagggcgggcagcgtgcggacggcgcgcgcggcggggtcgtagaggacggcgcggccggtgtggtcgatgccgacgatgctgccgtcgttcctgcgcatgaactccatgcccatggccgtcgccgtggtgcccggggagcagaaggccatggcgggtggaggcaggcgagcgtcctccacctccaccgtcgctcgctccggtttcgttgctagtggatggccatcggggtagaagagatgtgatgggttgactcgccgtagcctgtgggagagggaggggcctgtaaagcagtggtcagcaatgtacaagaatcgccggatcatcctcttccctgctgccaatggcggccgccggcggcgatggcgacggcgacggcggcggcggcgacgatggggatcttggctaggtttccacccgtacaagggcgtgaacgattaggaaaggtatactcatagattacttactcgtgggccgtatcctaatccagcatcgcgtgtttggcccaccacactcgtgggccggcccggctggaacggggcctcgtagcaacagctctgacgcacgtgacctctctttctcctcgagcgcagctgcgcaggtcgacgacccgggctccgccgccgccgcctcgcctcgccgccggcgcgctcgctcgctcggctggtccgcgtagtgggctgccttccatagtcggctctggaggagttttgagggagggaggcgcaggcatgggcgaggaagaagaagaccccgactggctccgcgcgttccaggtaaccatctcttctcctccgcctcccgtggccgtgtgatgtgccctagctaaatcctgccaggtctccgtgggaataaggtccatcctgccgagcggtttcgatttacccatttttctctgtggatttaagttgagaattgaactgaattagtgggcgcgctaataagtttgatctatgtcatttcacaaaatggcattccgtgttgtgcttctaggctatgtgttaaatatgctttgtgatgttcgtgagaatttcgtgctctttgataatccttcgcacaactcgatgcgaattttcggtattcagaaaacgttgtttgtacatgtgtttaacaacttgtttacttggtctatgccaatggttttgctaaacggtcccgctatggtatcgccgattcctagtttaaacacaacgaacacatgtcttgattttggttccgatgtccgataggctccgatgtgaggcagcaagcatgttctgtatctagtacttgttacactttctgttcttggtacaacttctctggctttccaagattgtgacttgttattggtgataatatcaccaattttattttgcataatttttcgtagccaccaactacatcgacggtgatgctttcttcgggctccgatgattctcctgaaaacagtcctacaaggactacaccatctggagaagaacaaaagggggaaaacaaggctagttcagaccatgcaggggatggagatgctgctgcactaaataagggcaaaaaggcaacacctactaggaggaaaacccctactagtcaagaaggtatcattagtttactactccctccatcccaaaatataacaacatctagccttcataatttgccctaaaatataacttcttctccacatacattctcttcttagccaatcgcaactttccaccattcaaatcccttcctacctcctcttctcaatcaatcacaacattcctctatttaattccaccatctttcttaatgcctgtattcaaccctaaaactcatattttgggacggagatagtaatatttattattttgttatgacaaacttccaaactagtatctcctttttattcactttctgatctattttctcttcatggttgcctatagatgctttcgacaaagatgagaaaccaaccatggaatcaaatcaagataagcctccaaaacgctcggtaactactataattcttattttgttcttaattgtttaatccctgttcgtggtacctcgccatctggtttctaattagttatgctgctgatatgtgatatgcccatgtaaaaagaacaatttaaaagatctatagatagattacgagctatccaagttcgaatgaggttcagcagattccctttttttctcaagatgctttattcctgatgtaacaccctgaaaattcgaccgacgaaatctaaactctaaaaatacggaccttcaaaaactttttaaataaagttgcatcatgccgattttgttccattattttaatgaattttgatctcggagtttataaatcgcgaataatggaaaattagttaggagaaaaccctaaaaagtaaattgactaagtaaataattaaagagcaatttaaaataatatttagagaggatagaaatgagtaaaatattattgggactatatttgtatcaattaaattaaaaaatgtaggaataagaattaaatctaattaaattcaagaaaatgatataaaaataaaatatgggtaaaattaaccagggatggatccattggttgggataacacacatattgagtaaaatgcatatatgtaaaattaggaatttttagaatcaaatttatatggggaataaattaaaatcgggataaatgggaaaaatgggaaaagtcactattcattgcccgccaggtgctcgagtgcgtcccctatctctgcccctctgtcccgtcgccgtcgcgcccgcgcgccacgcgcccggcgccctagccggccttgcgccccgcgccgccgccgcccgccgcgtcgccgctgccgtgccgcgcgccgtcacgttgcctcgcaccccgagccgccgcgcgccgtcacttcgccgctgctgcgccgcgcaaccatctcgcgccccgcgcgtcgcgcgccgctctgccttccctctgccgccgccgctgcgccgcgcgccgtcgcgtcacccgtctcgagccccgcaccgccgcgcgtcgcgtcgccccgcctgtcacgccgctcgccgccccgagccccgtgccgtcgcatcgccgtcgccaccgcgtcgccgtcccatcgcgccgcgcaccgtctcgtcgccactaccgagccgtcgtcgtcgtcgcctcgcaccccgtgccgcgccgcttccccgagccccgtgccgccgctgataccgcgccgcgccgcccgttccatcgccgcgcgccgtcaccgtccggccgtcgcgtcgcctcgcgcctcgcgcctgcgcgccgctcgcccgttccatcaccgcgacgcgagcctgccgcctcgcgccccgcgccgctgccgtgagccgtcaccgcgcgtcgacgtcgccgcgcgcgtcccatcgtcgctccgagccgcgcgccgccgctgccgagccgttcccatcgccgtcccctcgcctctgccgcgccgcgccaatgtcgccatcgccatcgccgcgggtcgccgtcgccttgcgcctcgcgccccgcgtcgccgtcgcgtctcccttctccttttccccccttagctcttcccctcccctatataagcctcactatttccccctcttcccctccatctccacccctctcctctacccacactaccgcgccgccgcctccacgccgccgcgccgtcgcaccgccgccatcgtgccaccgcgccgccgccctcgtgctgtcgtgccgccgcgttcgtgcccccgtgccgccgccccagagtgccgcaccgtgcgccgtcgtcgccgccgccgccgccgccgtcgccgccgtcggtgagccgctgccccccctccctctttcttttgtcgccgagccgagagagaaagagagaagccgagggaggaaaaggagaggaaggaaggaggaagccgggaggaaggaaagaaaaagagaaaaggaagaaaagaaaagaaaagaggaaaagaaaagagaggagaggaaaaaggaaagaaaagaaaagagaagaaaagaaaagagagagagagagggaaaagaaaagggaaaaatttagggggaaatttaaaatacttacaaatattagaatttaattgtaggattaatgaaaatatagttagatgaaatcttactaattaaatacctaaaatactagcatttaaatataggattaatgaaaatataattggatgaattcatatagattatagataatttctagtactctccataagaaatcaattcgcggtattaatttagatgtaattaataattaaacaaatgtatgaattctcgtaaattattgtggattatttctgggtaatctctataaataatcgattaacggtagcaattcggatttaatcactaggatgttagccgtgtattatatttaatcatagactaaattaagtcgtataatattctgggatttcgtccgatgtttagctcgcgatagaaatttctaacctattaattgatatgttactcgggtaggttaagttaaaaactcatgaccacaaaatatttatactcgcaaaatagtttaaatcgaaattgggttggccgtagtccgcggatagtgaagttaacaaaagggaatcgactttcgcatgcgacttttatttggattcatttggatttttatttgaattctaaccgaattcaaatcaattcttgcacgtaactatagagcccgagggagttgcagatccaagcgaaggccaagacccgcaagactttgagcaaggcaagtcatcactattctttgaacatgttgatcccaattgcgaaatggttttgtttataaataaaattgcatgcaatgatgaacaccctacttgtgattatgccatgccttgattattgtttacccttgaatccttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtacccctgcatagtggtttcttgatgtgtgaggcaggggctctacggtggggcagccattggtagaaccgcgaggcgggtgtctacagtggtgtcgccatcagtaggactgccttatgagaacctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgagcagtcgcggagtgcgggtaaagtgtacatccactgcagtgtgagtaaaccaaatctattcgaatagccgtgctcgcggttattgagcaccgggacatgtattacacttggctagactctaaactcttaacttgtgtgggatgggatattgcatgatgatttttatgctgatggagccatttcctgagaggtggaaatatggacatcctcagaaaaccataacgactcaatggcgggaagctatccttgggatcacaatggatggtggacagaaccgtcattgtttaatatgaatactggtattaaaacttgatcagtctatgctaggtcttaggcttgcgaaaagaattacaaaacttgctttgtgcaaaagaaccatagccatcctttgaattcccctgtcatgtgcatcattgctgtggtggcttgctgagtacggttggtactcacccttgcaattataaaattaatcagaagcgggagatgaagccacggaagatccttatgcctactaccaggagggagacgaagatgatggcgtccagtaggtcttagtacggtcgttgcctgtggcaatggcatgccgctgcctaaaattccgctgccttatctaaactctgcttttggttgtattccagaccgctcggtctgatgatttaagacaatgcctgcgggcttatgttgtaataattcgtactagactctcgtgtatgagcattggtattccagttatgaaatcgtgtgtaccagactacttgatccagggaaatggtacagtttacacgagtgattcctgttataaaaacgggggtctacacctgatgtcaacaatactacttgaatcttatcttacaactgttctacattatttgttattgatcgtcagataatgctactgttatatttaatactgacttcattgtacatattacttagttgcaaacaccaggtccactcttttgttaattctatgcctaaattttttgtacagactccaaagaagaagttggttaaacccccatctggttctaatgcttcaaaggttactggaccaaaagctggtccagatcaaatagatggtaagactaatgaaaagctttggttgccttttagtgaaaagtcagtttatgaattcttagtttcaatgattgataattatagtcatggtcatgcatagataccttggaacatcaagaagagggagttgctgaagaagacatgcaggataaacttacagagcactctgtaagatgcctcaacttccttctatttttaatctattttttcctccacactacggttccagaacattgagagcattgacccaaacaaggagcaaagaaaacaaaattagagcccacatcttactgggaatatcccaacatgtgtcatttttgttattgcattatattgaactaatgaaagttgggtaaatccttttaagaaggtataggaaaatatgaaaataaacatcattttgtaaatatttatcaagctccaaccgattagttctttccttgattaccgtaatttttgtagagcatgatggcgtgtcttgttattcctttaactagttacgtcaatatgtctgagatatcttatggactgtaagctcttatgcgttccaggtctcccagaggttgccattaatcattcctgataaaattcagcgttcaaaggtatgataattctaactggcattatcaattagaaaccattgttctcataaaagggtcagtgtgtcaaatcataagtccggaatgcaatgagcaactctgctatcaccccccccctttcccatattttcttcatggaaaaatatcggtcaacttaacattggtggaaagaaattgtacaattaatagaaataccgcagtgacagagccataaatgagaaatggttggggccctttttagtgcaccaggagttagaaggagtataggctatatatattaaagagccatagatccttgataatccaccaaaatgtgttatatgtgctaaaatgcagtaaaatcaacatcttgacctctgcaagtatcatctacctggaagactgggaatcatgactgacccaatcaatgatagtttccctaagtttataaattataatcctataatccttgttctgtttatttctaggcattgattgaatgcgatggtgactcgatagacttaagtggagacgttggagctgttgggaggataataatttcaaacagtcctaacggaaatcaggaattgttattggacctaaaaggtaccagcaagtcgatttctttagtatcatttatgtattatgcactttggtttctgactaggcagggtatttttaccaacaagggatttgaaattaatgtccgtgttatcttactacatgcactattcaaaatactttacccatattattattatttttacttatatacttacacaggaacaatatacaaatcaacaattgttccatccaggacattttgcgttgtaagttacattcaaacttaaagtacagttgtgcatttgccttatttgttagtattgatcttaaatccttgatggactgtctctttttctcaggtcagtgtaggacaaacagaagcgaaggttgtcgatgataacataaatctcttatgagtatttgacttctccataatttttagtttaggcagttctactttctagtatgtagcgtgctatttttgctactaaatccgattaaaatatattattctgatggatgtagctgcttaccttattcaaccatttttccccttttgcagatagagtctatcatggatgactttattcaattggaaccccaatccaatttatttgaagcagagactatgatggaaggttagcattcttctagatggtctaattagaaatcttcagcccatatatcctactgtttctgacctataaagctgagcagcaaactgcgcgccaataaaagcagcacatcttatctttctttaatggagctattaagcaatgcattgtcatttgacagtgtagtcaggaacagtcattctgcatgaagtgatgactaatgaccctatcatttgatatgatgataacatctgctgcaatggttattttctaatactccaggcatgttatctttataggtacccttgatggattcacatttgattctgacgaggagggtgacaagcttcctgaaccgcatgcttctcaaaacgatcaaaataatgaagatggggatcaacctaaggcaaaaaccaaaagaaaagctgagaaaccggcagtatgttctctcctacccttttaatgatcctataagcttcttttcagtttcttttctattaccattatgccatctcagaatttaaaactgatgatggcacatgttagcactgttgcaggaactaagttaataaggaacgtacccaaaatcacatctggagcaccttgagcttctgcagcagcaacatgattgacacgggcctttgatgctggtgcggtagagttgctctgggcagggacaatcttcacgcgtcggggcttcggacacttgtcagcgtaatgtcctgggtctccatagttgaagcacaccccgggcttgatgccttgctccttcttggcaggttgttgctgtgtcgaagctgcaacagggcgtggagcttgattgcggatgttgttgcccgcgttgttgttgaagaactgacgctgcggacgaacaacagacgaagaacctccctgtggcatggactggggtcctaaagtaagacgcggcctctgactattcccctgttgtgccttgaagtgagcaatccggcgtttcttccgctccatgcgatttgtcacgccctgaagttcccctcccttgctctaaattcataaaataaatcgttcgaagaaattgtttaatttaacctagagatgaatccctaattaataaatgcaaataataatcggaatcggcatgtggaattttcttggattctacatgtcaaaatatgctaacaggatttttagtggaattttcagagccttggaaataattttaatcaattaaaataagcaaagtgcaatattaaatccctggaaaaatcctttttcctttttatcttttcttttccctccttttttctttttcttgggcccggcccatttcctcccgcgccggcccgctcctccctcctactcctgaagttcacccggcctccttctccctctcgggcgctgacaggtggggcccacctgtcagccctttccctaacctccgaccgcccacgcccgcgccaaccgccgccgaaaccaccacccatcgccgcccgcctcccccgccttccgcgccccactccgcgccccgggccacgtcgcccacttcctcgcacgccccgccctccccgcgcccacgccccactcccgctcacccccgcgcccgcgagatggccaggattcgatttgaatcccgcctctctctctctcctcctccacctcctccactactccggcgaaattgcgccgttcccggccacgactcgccgcccccctcctatttaagcacgcccgcaccttcctctctctttttcctttctcggtcgagccctcccgagctctccatcgctcccgcgcctctcatcccgccctccgccgctcgccgccaagctccggccgcactccgccaccgctagagccgtcgccgcactgcgctgtcgacgccgccgggttcgcaagcttgtgcgccaccccgtccgccattgataacttgggtattaaaatgactagatgttggtttaggagatgcttagccatgcttagttcaactagtgcacaaaaggggatcacattaaagcatagactttgattattggcaatagctttggattagtgccaccgcaatggtgttggttaattaaaatacactacatggtgggctgtgggtgcatggttttgctagtcgtgcccatggcgactaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactactactgttttactgctttcaactactgctttgaaatgccggctttatgcaaaagaacctttagcctcccttggatataccctgcatcataccccccctcttccggtatgacttgctgagtacagtgggtagtactcagtcttgctctcttttccccctcaccagagttgaagttcttctcagttggagatgtcttgaagaggttggtttcgtcgctgccgtcaagggttgcctgtggaatggaatcgcccgctgcaggagtcaagtcttcaggcttagctcgctttaccttttccgctgcatttgtaatcttttatatttttgtaagacgtgaatctgtatgtcaacaattgtcgtttgtgtaccctggctggtcctggacaggggtttaatacacattcagcttagaaattctggttcgtgaattcctgggcgtgacacgattgtacttgtcctcctggcgaatagccttatccactaacttctggaaatcatgataatccccagtcatgagtgggtaagaaagctcatcattaagtccttccaagaacctctcctggcgctcttcatcagtgcgcacatcttccggagcataacgagccagacgattgaactcgtgcagatactcggtgaccgtgcgagatccctaggtgagcgacctgaattccttcttcttgagagacaccactcccgatggtatatgcgtcttccggaaagcagcggggaattcaagccaagtgataggttcagcggtagtcctgttaaggcggaagtgatcccaccattcagaggcagggccatgcagctggtgtgatgcaaacgagaccttctcttgatcagtgcactgaagcaaatccaacttcttttctatggcatgcagccaatcaccagcttcaacaggattagtggtgctagagaaagtgggcggcctcacacgaagaaattctgctaacttgttctggggaggtgcatagttatttccctggttctgctggttctggagttgctgcatcatcatgttcataagctgtgcctgttgagccaggacttgggcaagtgtgggattctctccattgttgttgttattgttgatgttggggccattcccgtcgctgcgagtgagcaccatctggcatgggcaggagcacaagaagagaaaccggggaaaactacttaggacagagaattaatttaacttttattgatcttaagtgagtttcattattacaaaactgaagactctcacaccactaaactcaccaactacctaacactcgaaaacaaacaaacgcatgcacttacatcccaccactgatgtaaatcacatgcgagaaacacacaaccaaacttaaaacaagcaaactaacacaacgatctaagacaacggtttgacaaggcattctaggtcttccgggcatcggagttgattgaaggctcgttcggctcgtctccatcatcttgagtggctccccactcgatcttggaatgggtgcgcttggattcttctccttcatcatcacttacgttgacgaccggaggatccgctagggctggggtaacttctttctccaccacacggacctttggcgccaattggtagcgagggacaaatagagctctcttccttgcggtaagacgaatcctggccttctgcggtggtgcttctcccttcaatgcggctagttccttctccaaacgatccactttgtcctctagcttgcaaatcttaccacgattctggtcttcacgatcttgagccgctaacacagtcttcgcacgggtttcatccatagcccacagcatctcaaccaaatgccttgtggtagcatcattctcaattccctcagtctcaaggtagctgccatggtcacttccctgtggttggcgaggatggtagcgataaggtgtcggccaactgatcactgtagcgatcgcggagctctcctatggcgatccttgccacctcctgacatgcatggatgtagtttcctcctccagcttcgaacatcactgaggagatatcttcactattactgttcaaggtgactttgactcggcacttcttttcgtgacgatcgtgaggaatctgggcatacaaaggggcagtcccaaatcctatggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaataaagtaaaccaagcttgcaagataagttgaaacagttggaaacaaggtcacaaattttgtacttttgaacaacaggttccaaaagaaataaaagaaagttataaaatcaacatgctaaatttatttcattgcagcaagattaaataaaacaatattgtaaaacttttgctggtaaatgagccattagtacagtaatagatgtacagtactaataacactggaataaattttgaatgagaaccactaaaagagattatgaagtgcatgtgctattagtttggtttaattaaaagagaaggggaggagaacagttctacttttccaatatttttagagggcttctatgggtaaccatttggcataacctagggtcaaggggctctgataccaacttgtcacgcccggaatttctatccaaaattccaaatgcttacatgtgtgtgaaccctcgtacaggaatcagccgaggcacacaataacaaattgataatagagtacaattattactctaattaataagcgaataaaatgtcattacagaggtagatagttcctctcaatcaataaagatctaagcagcggaaagataagataaacggcgcagacgactccactccacaggcagcttgaccagggctacacctaatcctccacaccatcagcatcactgtagaactcttcctctgatgaatgattgcaaggtgagtatatgacatactcagcaagccacgcagcaaatatgcaagtgcacaaggataccaaagaatggcataatatagggctcatttgcaaaagcagcatttagcaaacatttgagaattataaaacagtagagtaattaatcaccaattttaatcaacactaaacagcacacccatgctgctcaggcccaaccatcctgaacaaccatacccggctgtacagatctatctccaaaccaggaatataccattccaaaccaggagctaatcaaattattaccagttatagcatcttttattatggtgagaagtgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttatttgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcttatctaatatctagctgaaccaatatatatagcccaactagtcaagttataataacccaaggtatcaaggaataaagtaatcaatgcaaacaggccataacaaaggaatagattcacactacccagtgacattcgaaaataaatgcacaattgaaataaatagagaatttaaatataggatcaacatgctcaaaggattgtgtttaggatctgtgtgacttgccttgctggccttggaactcttcaaattcttctcctgcgaaaacagactctccggaaacgtcggaatctaaacaaaaaggagcaaaatcaccaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagggaattattgcgtcagcggctagggttttcggtggaccgggtgcacggcggcggcttacggaaacgaatggccgagatctttccatccaaaacggacggccgagatcgaccggtccacggtcggaccacgagagacgacgacgacgacgtcggcggtgacgtcaccaccggcggcggctcgggcgtgcatgctcgccggcgaacgacggcacgacagcgcgaacggagggctcctacgggtagcggacggcacggcgaactcaccggtgaccaaagcgacggcggacgatgaccggacgacatcggcgacgaggagaaggcggcggcactcttcggcttgacgacggcgacggtgctccggcggttgacagcgacggcgaaggggcggacgaggacggcgacgcgacggcgaccacgatggcgacctccccgagcgacggcgacgactggagcgacggcggcgacgacggcggcgcgaggtctcacggggctagggcgctaccgacggcgagagacgaaggcgagggtggcagcaggtagcggtggacttgggggtccttttataggggcaaggaggctgcggcgaaggcccacggcgaccggcgacgcgaaggaaagtctagggttcagaggagagagattgatccgaatcgaactcgaatccgcgagttccaaaacgatttagacgatgtttccaaaagggaaaaggtagaggggatcccgaggatcatttcccctctattaatttcaccggaaacagaaaggggcggttggatttggaaggagacgacggcggcgcggcgctagggttcgggcggcggcagcggcgcgaggaagacgaagactgacaggtgggccccacctgtcagcggcagcgagcgcgcgcgcgcgagcgggcggctcggctgcggactgggccggcttgggccgaggaggagagagagagggttttgggccgactttcggcccaaagccaaaagagacttttaaaaacctttttcaatttaaattattcatgaaatgcaattccatttattaaaaatacttccttagctcaaataaattccagaaaaatctaggaattatagagttaagcaaagtatttaatgaaattttatctggccccattttatattggaatttattaattaaaactagatcttcttttcaaggctttttaaaataaattctaataattccaattaaacaacaatttatatatttaggatttttaaggtgtgacaggcttggatcatagaagttcatgttaagataattgaattcattttggcctatgcgttgtgacatttgattatcatagaagttataggacgatcgaagtccaaaaaatgaactacttagaataccatattgaggacacggattattttcatcagcttgatttgaaaaaaaaaagaactacttagaataccatattaaagactactgatgtgagaatctgcacatccattgtctaattgaacttctgactaaacttttgttcaattagacaattaggcaagaatcatctgactgaacttgacacggcaagtcggcaggtggaggtatcctgatagataaacagatcacataaacaactcaaacatcgcaaacctgccaatctcataataggagaacattaatttgcagctttgcttacttcgatttcattttttctcaggtcaagaacaaaatttacatcaatgcgcggttgcaatctgagtagttatcttttactccgtacagtgatgacgcaaaacttacaggagattagctactacaactaattacccttcgcatgtccatggaaataaggtagcatatatatatacattaattctgaaccaagtctccgtatttcaggctccttgcagcatatggctttactctcagcttgctattcttgcccaactgcttgtggagttgtggggtgaaacaggtatcaccacctgcagaagaagttctagttctgaaagacaacataccttccatgatacattgatgccttgttgcctccagataggctcagaagtctatcataccaaagatgctctctactgaaggattcactaaacaacctttcatattttcatctttatttcctaaacctaaactcaaccttttagtaatggacacaatttctcggtccaggaatacagagaatgcgaccaataagaggattttaaaaaaaaatttcgaagggctatacctatactgtactgcactagtcactagataagtcatggtaagaatagggcctcaaggtatagtttgatgtacaactggttgctcctatagacataggaggctatagaagacaaggggtatgaaagcgttgtcgagttgggctgtatatgcttccaataaaccgctcaatgtcacagctaccaaaagtgatatccaatgctgtgttaatataaaagagatggtcaggatttatgcttgcttagtgtattgtagaataaaagcttcaaatggtttaatgccaggggggaaagtaaaacctgtgaaagtatgtatccacttgaagctaagagtgacagcaggattgagcaggctgctaatacagaagttatgcctgctgctgtgcccttaattgttttctctaacatttcaaaagtatgtgcataagagatcaattatcaaccatggaataaataataatggaaatcaaactcacttcctgtcttgctccatcttaggacaccatacttataacctatcattgatgcctaggtaaaacaagagaattcatcatactgaacgcagctaacataagaaaatattaactgatcacacactggacatagaacctaccatggtatcaccaatacccaagctgagaattccagcaaatggtgtaagaggtcggtcattgaatcctgatgacatccatttaggaagtgcacatcccagcaagagtgagaaatgactgaacaaaacaaatatagtattaggcctatccaagtattgagcatgtaaatgagttaaaatctggaaaacaacgaccattcatccagacctacctaacaattagaatctccgaatcgcggtgatcagtgaaagcactcatgaactgatgcacaatatgcccaagagggtatatttcccaaacctgaggtcagggtgaaacatttcgttggagaaattagcacatgttggcatacaaactgccaaaaaacagagaaacgggagaaagaaagggatacaaataaagaaaatgcttactcgaaccatctccaatattaagaaaacagcaaatgctgcaccaaatgccaagtccaagaaatcaggctgcaaagagaaaaaatttattgggagtgtgtttcaaacaatctgatagggatcgaataacgaaaacatatattacctgaaatattactgcaggagagaaaattaggacagcaacgagatggtaatacttgcgcaaaagaatcctctccgttttgctttgttttgatatactgtagaaccttctaattgatacatatatcacaaatatccagtttgcgcataaagcaagccgttcacgtgaatcggtgaaaatatagttaaaaaccctgtgaaataataaaccattaagtgaaccaaaattcaatatgtacaaaaatgcacaaggtttagaagcaacacaggaaaaaaaaattcaatatttgactaacaaagtgcatgcttttatgcccttccaatgaaatgcaaacttatatgctcaccaaacaaatggatgcacttcaaaaccttgaataagacgcgtccatgatggcactaacaacaatagtgctatcaacaatgaaacataaaatacaccacagtcaattctcttctgtgtgcattcctcaactgtttgtgttctttgactctccagttttctacagtaagccaaaacttgaagggagcttttgtataacaaggggagaagaaaaagaccaagcaaaaccccctgcagaaaagaaaaaaaagggaagggtattatgcactaagaaactgaagccagacaacgcaatagcttctacctgaataactgtgcctatctcgtttcgagttccaggtgcgcgaataaatgcttctgatgatacggagaactccatctgccagcagcacggttgcaaatgtgcaggcaacaaaataagtatcagatttgctaccattttgctggtaaaacatagttcgaggaataaatcacacctttgaaagagtatgagccagcatatcaccacagtaaagaaacaagaccacttgagaccaaaatggcctcccctaagttcacagaaaatgtaaagataagttaaaaaaagcaatagcttcaagtcatgatgaaaaggagacatatacattgcatcggccaataggaaccacacaaattagctgaatttaaattttaaaaaatgaacagtgtagacataatgcaccatgcctgcatggaaactggtaggataactagcaatcgtatggatagctctaaagtctaaacatatgcagtctgatataaacaaaaaaaaaagaagatctacatcttagacttcaggtacaaaccaaaagatgaacatgaagggaacttctctagaatatgctggattaagatcacagcagccactccatgacacagcaaatacaccaaattactcatcaccagcagacctgttaagacaacctagattagtttgtaattccttgcttctgatgaacttccaccagattttggaaagaaagggtgagactatctttgcatgcagataaaatatgcatgtacctccatcagtcttcagtaaaaggtgaaacaagtatgccaggggatataaaatgatgagcaacaagccgtatttcgaagctatagaatttccattgctgggagactgccgtagatgccaaacaaaaaatgctaacatgctgaggcagctaacagatactgcccagtactgcatttcaaggtatgcatattctgacaatgaaccacatatgtagttagtaaaccagatgcgtcaccgaaaatcttagtgtcaaacaagatttgaaatgttgatgaagacttggggaaatttccatttagtaatggaactgataaatttgacaaaatagaaaaatggataccttcacgtccattaggatcggctagtaagaccctataaagttgaattaaccgtgaaagcatgacactaggcagagtagtggcaccaagaagtatgcctgatgaagcacccggcctggagcatatacatatatcatcatcaagcactgaacaatcttttacagaaacatgcacaagagcatcaagccaccacaagaaggtgaagtcctcacaacacaagacgtgacaaaatcttacagtaagcaactaggattgcacatcacagaacccatataaatgacagtgggagcaacgtttcagctgaaaatgcaatggaacagtattttggccatcaaaatgggagcaatattttgactggctttatgataaaagcacctctgaatttcccatttgtgaaatgggttaactaagaaatgctgaaacccaattattcaagagtgatatttgtcccttggattgttggaaccaccaatatctgaccccattttacacactactgaaccaaaataaaatccactaagcctcaagtacaagtaaaatcacattcctgcggtatgctgaatccgactgatgtcgtttccccaattgcatgatcctcacagggaggcagccagcattgaaccaacaaatggataaattcgcctcagattctacggctgcgccaacgaattttgcaaaaacactgcaccttgcaggttccctggcatcacagggagctcctctaagacttaattcgtggggggttcgaaactcgaacactggtatcaaagatcacgcaatcccccaagctaaccaaatcgcgcgaactagcagcccagctccgtggagatgcggcggaagaaaatacggataagaacgggggaggatataacgtcgcacctggtcctgaaccggcggagcggggatgaggacgcggaggcggaggcggaggcggaggcatccacggcgagctcgacggcgagggcggccgcggcaaggactgcgagcggggcggcgagctgggccggcgccgcgagcgcgacgcgggcgacgaagaggaacacgacgagcctctcgcccgagaccaccgccggcgccatcgccatcgccggcgaccgaggaagcgcacgaacgaagggagcgcggcgcgaaccggacgggccttggtggttctgactgacaggtggggcccgcataaaccagacgcgggtggtgggtcaaagcggttgagccgccgcgtccgacacgggtgtgggtgtggtgcaccgtgcacgcacgcgcaccggacctgacctggtcctcttgcgtggcgtcaagcgtgtgcgcgacgcggagagaaacagtggccgccgctgctactgctgtttttttttttcttcttcttcttctttttggttttgtgactcgctctcgtatatgtgggcgtttgcgtcgacgtcgtcgtctgggcgttgagttggatgggaatatggaatgattcctgagtattttgtaccaccgctccaggcaaaattcacaagtgccgcaatgttcaagcaaaattcatgttctatgctactccattcgtcccattataagttcagtcatgagtttccatatctatctttgatcatccatcttatttgattttttttatgattagtatttttatcattattagatgataaaacataagtagtactttatgcatggcttatatttttgaactttttttttaaaaaaaattcaaataagacggacgatcaaaattagacacgaaaaattatggttgcacctaaaaacttaaaatgggacagaggtagtatcaaatataagttcgacatccacaattcttgttctcagataggtaactagtgactgatgaggagcttgtctgatggaccacaaaccacaacatattctcaggttggatggggtagatacaggtacaatacaatttaaaatattttctagagtaacaactaacaatccgggaagaaaacagacaccaagataaaaccatccatccattgatccatctgagactcagagcagggtagtaatactaataccacgttccaaacatacataagtgacgttccaggcatagtaataacattactaatacagacgctaataataagacaagatcacaatctcgaccgtagcttataacagttttttgctaataatacagttattgggaatttgggacagcagtaatactatgtttgatcattttctcttcagagcggaggggatcatgcaacggcaacaaagtgtgacatgcaggacagatatcatctccttgggatctttaatctaagggaactcctcagcaaaccgggtcaaaataccctgaacacaaaaccagtaacaaaaacgtcagtacatcagaacaggtagcaatttatcattacattacacaagtaaaccagggggaaatatatcctaaacattgcacccccttcagaagcaacaagcctgcaaatacagaaaaaagaaatgcaacttcaatgaaaatgcttccatcacaagtaaacaccatatgaatatcagccaactcaaataccacctagttcaagcttcacacgcatatattggatgacggtacatggaaatgtacatcctgcctgccaatgcgttctcacatcagatgtgttctttgcatagagggaagaaaaaggcagaacataaagcaaatttgcagaaagaaacatgaaaggaaatacgaactagtgcctgcacactatggttcatatgataacaataaccaaagcgttggcgccactgaaaatgagcaaacagaacaaatcagctgttggtgcaacctagtccattcaatataggcagctcgtgatagatgttcactgaaaccaagtaaccaacaagaccatacaattctaacatatcaatgtaaagtgatttataaaaagctgcagctctatttttctgagttgtttcaagttacaattactccagcaggtcaaactgcctaaggcctaataacatacagtagcccaggctaaggatacccatttgtcaaggaacagtgctaactgataaaacacttgcaaggacagcagtaaaccaaaaggaatcatacatacgagtaatgcaatggttgctctttagaaaaagaaatcacctgaatgaacaaatgtgaacccatgatacaatatcacagcagaagtttcaataatatttgccgcgaaatttaagtaaaataataggaaagaaacaacacttacattgatcagacaaacatcgccagctctggacggctgtagatgttatccccatcatcatctagtgcaggataagcagcaacaagtgcatcttgtgcacctatatataatgagttgtagattttccaatatacttcacgtactttccttgctggatggaaaaggccttgaaggcagtaattcaagatcacagctggaccaagagcaactctcatcccctcaatcgcctccatgacagcattgatgacatggggagatgtctcaaatatgttgggccagacatagttaagcaaatggacaagagcatcctcacagcccaagccagcaacaccaagagccatgtgtttcacagcagaggcagcagtttgccggtgaacaagatctctgtccattagagcatcttcaagcaagggagtaacagcatatatgtaatccttgcccatctcaccaatatactcaaagaggaaagagagagacttcaggacaccattctgaacattgagttctgggacccggtactcattcatcagggcaggcagaactgtgaaaggcgagcaggtttcagcaacaattgcaatcgcgacagtcgtgcagacacggttttgtcgttcctgcaccttcaagttattcaacagagtcgccaacacatcctgtggcccaatagccttcgcaatataaccaaatgtgttcacagtcgctcttctaatacccttcttgtgagccttcaacatttcaagaagctcaaagcaaatcctcatccactccctagcaggcacaaattctgctccgcgatcagcaatcctaccaactagatcaatgcagttctcctggaccttctcatgcctattcttcaagataggagtcagccgaggaagaagatccttgattggcggtgtcatcttagtcataccaatgacattcacaatagctttcaatgctccaagaatcgaacccaacacctcagggtactcctctcccaaatactcatacagcacaacacccaaatgacccataagctgctcctcctgacattgtttcatcacaatagctatccttgagatcagatcagcagcttgctgcctaacttttgcactcttgttgttcaaccgccacttaatggtaccacaaatctgaggaaggtaaggcttgaccctctgtcccagtgcattgacaacagctccaaaaccattaagcatgacatttgcatcatcacttgtctgctcttggaaagcatacaggatgccatcaataagcagctcctccaaacgagcatcaatatctgaagcacccaaattagccaccaccttctcaattgtttccatcaccattctcctgtaaggctcactttcatctttcagatcctcaacaatcctcccaacaatatcagcaactccaaccttatttgccatctctacagttgtttccacaagctgcttatagttcctgcggtccagagccattctcctaacccagaagtgacggaaaaactcaggaaggatgtcattccggatataatcagcctctacaccctctgtactgacacactgtttaacaaccttcaggacaatcttcttcatttcttcatctggtgactggaactcccttatcaggatttgcatgacctccttcgtgtagtaactggcatacagcgcatccataagagggatgatgaaaccaatagctttcaagaaggcagcaagaacctttccacggtgagatctgatacccttccacagaggcttcaaaacagtatcaaaactttctataccatatggtgcagcagcctcagcaagtgtagcaagagaaagggcagtgattgtccgcactttctggttctcatcactaagaccatgctcaatgatctcgactagggacttgagatgtggcagaacagcgcagcccataagaatagcaatctgctgaacaatcttgataccagtgtgccgagcttgccaggacttcttactctgacagacagcctttaagaatggcaggagagcaggggtacccaaagcagaagccaccacgctaaatgctctagcagtggtatttctcacatactcatcaatgttatcaatatctggtctcatggcggcaatcatagtagcaagaccagcagctttgctaagatttgagataatctcccggccctcaacacgagcatagtagtcctcatcaatcagaagtggctcaatgaccacaagaatcttatggacaaacggacggactagctcatccagcttatacagtaccctgtcaatgaccttcaccagaagatgccgctcctggtcctcaattgttggctgcatgagcaagggtagaatcttgttgaacaaagggccagcaccaaattcccttgctttgtctgtcagctgtcgaagtgcgtataggctggtatgaagctggaggttcaagaatcttgtacccttcctgcgggaacatagtatcaagctcctcatccgtaagaggcctgttccgctcctcaatgtcccgctcccaccgcaagagctggtactgctctggagtcattggaccacgagaagcaatctggccgggtgttggcgtcgcaaggttgtcaccaccaaatggcgtcggaccaggagtgtaacctgcaggcgtcgcagcaccagtgcctccaggtgtagcactacccatacttgcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggggtctcatcccaccgattccttctcaccgacggcgtcgcatccccgacacgaccaggggtggcatcccagcgcccaatcccaggagttgcatcaggagcatcccagtcggaggaggtcttcgccttcttggatccaacagcagcagaagcatcaccatcctgcgactgatcccatctattgcggcgcttcggcgctgccactggctgctgctcaggcacggccttcttctccttggccttctcctcctcttccttttttcttctgagctatatcacgcagcagctgctccttctgcttctgcaggtcattctcgcgcatggcatcagcatatgtccgcacggaagggtccggggtggcctcaccagcggcgaagggatcatggcgctccggcgagatgatgcgggccagccgccgccggcgatagtcatcctcgcggtcgatgatgcgctgcgacttcttggggaggccgtcgtcctcggcggcgcgggggatgtcgggggcggcgacggcgtggccggtgtaggaggcgaggcggcgggcggcggggttgacggccgcctcggattcgtcctcgggcgcgtcgtcctcggaggcggggatggaggtgtcgtagccggcgaagcggttggggtcggagccgccgccgccgtagagatcagtgtcgaaggtgacggaggagacggccatgggcgcgccggcggccagggcctcctccatcttcttgcgctcctcctgcgcccgcgcaagctccgcgtcgatgccgtccatggcgccggcgcggcgggagaagcggttagggtttcgggggtggagagattagacctggatttttcacattttggtccttttaaaaaacttatttcgcaagtagacccctagaaaaacttatcccaaaaatggtcctttttggggcgccagagtggctggcgccgtcgttcaacaggacggcgccagcctctttggcgccgtccccctgccgacgtggcggggcgatgctgaggtggctagggggagtgcgccagagtggctggcgccccccccccccccccgaaattttttatttttgttttatttgtttgatatttttttttcacgcttagggacacacaagaaccaaccatagaaaaattgaactcaaatggacgtaatatgtgacatgtagaatttttcctctcctctcctctctccgaactagtacagaggagagagatgtgcaacttttttatttttattttatttttttgatatgttcttcacacttaggaactcacaggaaccaaccatgtaaaaaataaactcaaacggacgaaatatgtggcatgtggaattttccaaagctccaccgaaaaacttctctcctcgaaaacacaatcttgcaagcggaatttggaggttttaatatcgacgaacccgacaaagcgggggagaatcggatgtaactttttctgtagatgtccgtgcatatattatttgcctgattccgagtccgtatgagaaagttacgcctattttaatagatgacatattttgtccgtttcggtagagttttggaaaattctacatgtcacatattttgtccgtttgagtttattttttatacggttggttcctatgttctcgtaagtgtgaaaaaaatatcaaaaaaaatgaaataaaaataaaaaaattacatctctatgtactatttaacttatatatgtcatttcatgtggttatattttgaattagattaagtaatttcatatagtggtagagtgcattatgtttaacatgctgatcaaagagttttactaaaagagttatggtctaattttagtgaaggtgcaaagtagactaagtggtatgctagatattttcagacttagctaagtggtagttcgagtttaaattttttttgtggttggttgtatcgtgattctgagtgtgaaaaaacatcaaaaaactccatacagagaaacaggaatagaggcggcggcgccagccatgctggcgccctcctccctggggcggcgccagcatggctggcgccctcctcctgccacgtcggttcgcgtgcgccacggtggcaggaggacggcgccagagaggctggcgccgtcccgttggatgacggcgccagccactctggcgccccaaaaaggaccatttctgggataagttttttcaggggtctatttgcgaaataagtttttcaaaaggaccaaaatgtgaaaaatccaggagattagacgagggcacgatgcgagaatggggaagaagagcaagtcgtgaggtttgggctctcgtgctagatagactcgctgacgtcatctttcatctgggccgttgattggctcccgcatgattgaggccgtccatctgaaaaacatgaaccgactttgcttccgttaattgatatagtactactcaaataattactctcgaatgcaactaagaccaatccaaaatcgtaaagctaatggatgcagatggacagaagtctagtgcctaatccattttctctaaggaaactgtcatgttcgattattctcacaacccaaaaaggtaaatgttctttccagctgagcttattagaacatcaggtgcacgtatatcaagcagctaaaacggcatcatcttttataaaactccctatataagtttattgaaaacccaaacaatgtttttagaaaaaaaaagagttatacttaattaatcacactctccgattaaacggttcataagactacattcatttcggtgagtgggtggcgcataataaattgtgtattaattattatagtttttaaccttttaaaataaaacactgtttaagagttgagaagcgtgctagaggaaaacggataagtgatacatagtaatttttaactcgatctaaggcgtccgaaagagaaattgcggttgatgttaacctgtgcactattcgaagagcttctaatcactacaatttcaatccccttcaatttccctctcttgggattaagcgaacaaggtctcaatcatcttcaatcccctctaaaccgaacaagaacttaagcggatgttcccttagatatctaaaaaccattcaaatagttatgattttctttaaaaaaaataacattaacatttctttctcaacatatagtttgaatttgaacttatttttttcagtgttagttgtcactgaaccctacattgtcattttcttttcaatcttttctgaaactatttgcattgaatttggaaagagaaaaattgcaggggagccaaccccttgagagtttagaattcacttccaacaactccagcaaatctaacaagtttgcttaaacaaggatgcatgaagaaaagaaaacaaagaactgaataagtcagtgtaatcgaatgatctgaacctcgataagtcagtgtagtctaggcggtgacgactccaccaactcccctcaaaacaccccgtccccaacaaaaagttggaaacacgcccagaattgtttcatcaacaccgcaaaatgcgggtgctcgtcgtgaagggccgcgccgtggtggcggagaccatcggttgctgctgccgcaccgccgccgccgctgccgccgccggcgagacagcgcactttctcttcaccgccgagggcatccatcaccgtagcttctcttccacccctccccctccgccgcgtcctcacgtcgtcgggtcgtcgtcgtcgtcgtcgtcgtcgtcactttgggccggcgatcacagcgacaggtacggctccttctcatcacatcaccgttccttccgcaatccgcaccccgtgtttccgagtgttctgaaataacagtgcgcttcaggtggcatggaatcggcggcgaggtgcagaggaaacgcgagtacgagggccacgttggcggcggaggcgccatggcgactccccgattcaaggaggaagacctggggctgcgcgtgatctcgcttggcaaatgcagccgccacctcgttcacgcgcccaggtccgcctggttcatgctccacgcgccgtcgaggcgaagcttctcgacctcggcgtcctcctcgccgtgcacttcgccacccgcgccgcctgagaccagtccgccgaacacttcgacacccgcgccgcctgctccagatgtgccagagaacagttcgccgccggattatgatctctgctcagacaggttcgcgcaccaatccaccattgtttgtttggctgcgtgagattgcattgtgtgtgattactgcaactgtcaatttggatgtgagattgcattattaattattttgtgcgattacttgaattgttagtttagctgtgtgagatttcattattaattattgtgtgctattactgcaattattagtttgtctgtgtgagattgcattgtgtgtgattactgcaactgttagtttgctgtgagattgcattattaactattttgtgcgattacttgaattgttagtttagctgtgtgagatttcattattaattattgtgtgctattactgcacttgttagtttggatgtgtgagattgcattattgatcactgtgtgcaattactacatattgcaggtgctccttaggtgatatgcttgaagcgtcctatgatcctgtagagttcgtgcgcaactttccagcagtaatgttcagcaagccgaagaacgcccctgacactttgtacgatagatgggttttcaaaggctggttccaatctgctataagagacattttgagcaaactagaggatcatcacatagccggtctggagtttgaagatattaatactgagaccatgacaatagcttgcaatattgattcaagcgagttctatcccaggttcaattttcatgggaagaccaggaacattacttttgaaggacagaaaagaaattacactcagcttggcagcacccttgagaaattgatagccatctcagcaagtgctagtaatgtccatgcatatcatcatcaactcttgactgaagacgctaaagacttgctgaacaaaatgaggcatccttcccttgatcgttttgaggcatacatgctcagaaaccacccatctttacttcagatcgaagcgcatgcctctttctaccttacctgctttgatcacctgaagctattgcctcaaaagcctgttgaaaacttcttcaaaggactgccatacgcggtaggagaccagcatggcgattggattgcaattgcacatcaacacccgcttcttagcatgcagttaagccatggatatagaatcagcaactggtcgcaggcaacgtataggagggacgggtactgtcatagaactgaacctggatctaagtattcgatcgttcaaacgcacaggatatatcaccagtatttccctaggacactcccagctatgatgtggggaatggtggctctacgtcagcacaaggtgatagattttgacaggttattcaaatgaggggaacggctagccaggtaaaggtcagcagttcattcccctttcattatagtaggtcattgtgctctctgatctcctgtagtacatgaaacaagattttactaactgaaataccttttgctttgcttggtataggtatatcttgggagacaattgcatagcttctcgatgaaccaccctgttcctgttgctttgacagggacaacgtacagttgatgttcggttcacactcaacagtcctgttcctgttttctttgacaaggacaaagtacgggttgatgttccgttgacacagtagtcaattcgcagtatctgtactgcaggcatacaaattcgatgtcaaagccccatgctctgtggttacattgcctttgttagtacatctaccactgttcattttactaactgctagtaaaaacatctaatggtatcagattgtcagttttggaagaatgattacacagaattaagtttggtgttttgtttggtttatagccttagttaaaatatttctgtaagccaaatacgagcgttgcaaaatttgtgacgaagttaggtttgttgccaatttttcttggtaaaattgctttgagcattgtttaatttgagatcaattagagactaaacaatgtacactaccatttcattttctgttggcaacaaaccaaatgtgtttgccaaattgccagtggcgggcccagctttttaaacttgggtattcgaaatgggaaggggtaaaaaaatgtccatacaccaaaaagccaaaaaataggcttgtatattatgatacactaataattataatttagagcgtatagaataaaattgatcattagttcacacagtgatagaattgatcatcactagaaattgtttaacttatagaaatactaataccaaacatatcaaagtgtcaaaatatggaatacaaaaatgatagagaataataagttaggaagaaaacttacaatttagatattaacttttcgacgcttgatattttggaaataattgatgatgtccttgtccttagcttgcaaaaagaattctctttcaatgaatgtaaccaaacaatcattcaaatactacaaatttgctaatatggtatgaactatgaactactgtccagtgtccaatatactcaattactcaaatactcaaataggcaactagtcaactacaatcctacaaactaaatgtctaaatcaagcaagcaagcaactacactaaaatactaaatgtctaaatcaatgaatttttgtgcttgtcccgttgtccggagtttagtcactcactgtgctaatgtgcttatccggaatttgcaggtcaggcagtcgccggcgagcaggatgccgcacggccgcagcggcagcgcgcagccgccggctgcctcgggcctcggcgcggaacggcggacgccgacctgcaggctgcagctgtgcagcgcctgctcctgctcggctgacggcctggagcagcctcctgcctggctgcctcctgggcccctgcaggctgccgcgccggctgccgcacgcggcacgccgtcgcccgtcggtcacggtgcgcctgccggtcacgggcttggcgccttggccttggcggctcaccgcctcaccggtcgccgtcgccgccgccgcgccggcgccgcgcccgcgccgttgcacgccgcgaccgcgccacacgccgccacggctcccgccgccggccgccgcacgctgcacgcagcccccgccggccgccacacgtcacgccgccgcacgcctcctcccgtcgccgtgctgtactgctgtgttgtggtctagggtttgcaggtttgggtggccaaggcgccaggcgggtggggaattgggggaaaattgcaaatgggctgagatgtggcccaattagaccacaggtagagaggaaagagggaggggagtggaaaatttaggcccaatagagaagaaatggggaaacaaggcccaatataagcagtttaagttttctttttatttttttaatacctatatgaactatatagtatatatacctattttttttccaaaaatcttgggtatacatttgaatacccatgaatacatagtgggcccgcccctgcaaattgcattacccttgcaaaagaattgataagattcatatttgtgcatcaatccaaacaattactggatcaattcaacctcaagtttttttccctgcctttattcttcgggtcactctccggcccggtgcctctatcttagtcaggctttaggaaaactagataatgggtttgtcgatgcagcatgcatcgttaaacaacattgactcccatgatctgcacctgtggcgaaaacaagaccaaagaggcaaagattgtcgcatcaaatgcaaatttagagactttttctcccttcgttctaacatggtgagtcattcgcttgatctgaaaatatagcatagagcaaatctggttgagtgcaaatgtccacatgccatgggcacagttagctgacaagaagtgcctggcagacagtagataattacatgccattttcacatccatattcacaaagataatgcactggcaacagtatacactagactgcaagatgaactatacttcccataatcattttccatcatagtaagtaactacagacagctgttacttgaacaatgacacaaatatgatacaatacacaaggataagaagagccttatagtgtctacgttgtttgacagaaacgtgaatgtgtaaatgaaatttgaaagaacattgtttgagtaattcagctgtcagacacgtaaaagttaacaacatccaatgatatggaagggcacgtactgcttgtatcagcacattctttagagagacctaccaaacctaatcaacaaatcaggaaacttcagattagaaaaattaaggtcgaaaagaagcatatgtgcaatgattggcatgatcacaacatcacactgcctatcagaactttataaatgacaatctccaactatgtagatttatttttctgcttgtgtgccttagatacaatagtttcagttatacacggtgtccatatcacagtccaacatcacgaaatgaccaattgaaaaggatatgtagtatctaattacaataccatgctgacaccaataggttcaaacatgaactgaaacgtcatattgatatgcatacttaatataaaaatttaacctctcctcaaaaaaatatatatataaatttaaccttattcctaacaatgttttgtgacttcaacaataaactgaggacttgagatggagatgaaaagacaaggaatcattatagactcacaggagatagtaccaggcaatattggcatgttgtacttggatctaacgcaatgtaactgaattatgaggaaagaattatgcagaggcattcattgaaataatgcatgtgatatactcattgaaaagtatattagagtaggatgcacagctaaacttgtaagttacaatggagcaaaagaaaacaaaccccaccttcaaagagccttgctaagatccatagtgtttcccaaagttatctagtatataacctttcttgaagttcactgactaactgtccttaaagaaaagactacattgatcaaggatttatgccagacaaatttcagtatgactttcttcaagttataagtacatcgacaacagtgactaaatgttttggagtgccataatcaatagagagaaaaaaaaataattcactagagactattttcattttagtaccaatatgatttttgttaagggggtggagtgtatgttaacagtttttttgcccaatgatgatttaagcattgtgtttttctcatcgtcaatactacatgcatttatgcagcctgttaaaggaatgaaaattatagagagacgagctaacccgcatggccacatatgcatcaaggaagctgacatattgctttcaggcttatctgttatggcagctgccatttgttgtcactagtattagtttttggcacttagactgctatctgatcagatgataagtatttcaggttataaatgtttttttttcaggtccttaacaatagaattgcttccttgaaatcattcatctctactaacagagtttacagagctatgcaatgcagagttttaaaactaaccgatgaatatgtatcctgcataagagcaggattaatcaaataagggtttttattaggacagtactaagtaggagtactctactcgttagagtagataaacaggggtgtagtcttggccgaagttataacggcgcgacttgtgcttgacgacgcggagcttcccgccacggccgcgtaccacctccacgccggtgagcatggcgaaatttatttcacccctttctctgcgatcaacactgaacatcttggcgacgcacagcttgccgccgcccaggtggacgacctgcgatgcgtacacctccaactccctcctcctccggtcgtcgctgtggctctccaccgagaaccccttcacctggaggctcgccaccggcggctgcggctgctggaacgcggaggacagattccacgctccgagaatggtgccatccatgtcggagatgccgaaccagaggccgtgctcggggacgtgctcggcgcggccgcggaagggcagctcccagtcgccggccttgctccacgcggagctcgcggtgtcgaaggagtaggtgccgttggtcgtggtggataccaggatgcgcgtgccgccgtcgccgtcgccggccaccgcgtacccgcagatcatgccgcgggaggagccttcgaagccggcggcgtaggcgttcacgcacggggacggcggcggcggcggcggcggcaggggttgccagaggtagttgtcccctacctcccacttgtcggagtcggactcggcgggattatcctcgaggcgtacgagcgcctcgaagcagccggcgccgtcggggaggggcgtcgtctccatgacgtacaggtcgtcgccgacggcggccgagacgggcatgagcttgggcgccgcgagggcgggcagcgtgcggacggcgcgcgcggcggggtcgtagaggacggcgcggccggtgtggtcgatgccgacgatgctgccgtcgttcctgcgcatgaactccatgcccatggccgtcgccgtggtgcccggggagcagaaggccatggcgggtggaggcaggcgagcgtcctccacctccaccgtcgctcgctccggtttcgttgctagtggatggccatcggggtagaagagatgtgatgggttgactcgccgtagcctgtgggagagggaggggcctgtaaagcagtggtcagcaatgtacaagaatcgccggatcatcctcttccctgctgccaatggcggccgccggcggcgatggcgacggcgacggcggcggcggcgacgatggggatcttggctaggtttccacccgtacaagggcgtgaacgattaggaaaggtatactcatagattacttactcgtgggccgtatcctaatccagcatcgcgtgtttggcccaccacactcgtgggccggcccggctggaacggggcctcgtagcaacagctctgacgcacgtgacctctctttctcctcgagcgcagctgcgcaggtcgacgacccgggctccgccgccgccgcctcgcctcgccgccggcgcgctcgctcgctcggctggtccgcgtagtgggctgccttccatagtcggctctggaggagttttgagggagggaggcgcaggcatgggcgaggaagaagaagaccccgactggctccgcgcgttccaggtaaccatctcttctcctccgcctcccgtggccgtgtgatgtgccctagctaaatcctgccaggtctccgtgggaataaggtccatcctgccgagcggtttcgatttacccatttttctctgtggatttaagttgagaattgaactgaattagtgggcgcgctaataagtttgatctatgtcatttcacaaaatggcattccgtgttgtgcttctaggctatgtgttaaatatgctttgtgatgttcgtgagaatttcgtgctctttgataatccttcgcacaactcgatgcgaattttcggtattcagaaaacgttgtttgtacatgtgtttaacaacttgtttacttggtctatgccaatggttttgctaaacggtcccgctatggtatcgccgattcctagtttaaacacaacgaacacatgtcttgattttggttccgatgtccgataggctccgatgtgaggcagcaagcatgttctgtatctagtacttgttacactttctgttcttggtacaacttctctggctttccaagattgtgacttgttattggtgataatatcaccaattttattttgcataatttttcgtagccaccaactacatcgacggtgatgctttcttcgggctccgatgattctcctgaaaacagtcctacacggactacaccatctggagaagaacaaaagggggaaaacaaggctagttcagaccatgcaggggatggagatgctgctgcactaaataagggcaaaaaggcaacacctactaggaggaaaacccctactagtcaagaaggtatcattagtttactactccctccatcccaaaatataacaacatctagccttcataatttgccctaaaatataacttcttctccacatacattctcttcttagccaatctcaactttccaccattcaaatcccttcccacctcctcttctcaatcaatcacaacattcctctatttaattccaccatctttcttaatgcctgtattcaaccctaaaactcatattttgggacggagatagtaatatttattattttgttatgacaaacttccaaactagtatctcctttttattcactttctgatctattttctcttcatggttgcctatagatgctttcgacaaagatgagaaaccaaccatggaatcaaatcaagataagcctccaaaacgctcggtaactactataattcttattttgttcttaattgtttaatccctgttcgtggtacctcgccatctggtttctaattagttatgctgctgatatgtgatatgcccatgtaaaaagaacaatttaaaagatctatagatagattacgagctatccaagttcgaatgaggttcagcagattccctttttttctcaagatgctttattcctgatgtcaacaatacttcttgaatcttatcttacaactgttctacattatttgttattgatcgtcacataatgctactgttatatttaatactgacttcattgtacatattacttagttgcaaacaccaggtccactcttttgttaattctatgcctaaattttttgtacagactccaaagaagaagttggttaaacccccatctggttctaatgcttcaaaggttactggaccaaaagctggtccagatcaaatagatggtaagactaatgaaaagctttggttgccttttagtgaaaagtcagtttatgaattcttagtttcaatgattgataattatagtcatggtcatgcatagataccttggaacatcaagaagagggagttgctgaagaagaaatgcaggataaacttacagagcactctgtaagatgcctcaacttccttctatttttaatctattttttcctccacactacggttccagaacattgagagcattgacccaaacaaggagcaaagaaaacaaaattagagcccacatcttactgggaatatcccaacatgtgtcatttttgttattgcattatattgaactaatgaaagttgggtaaatccttttaagaaggtataggaaaatatgaaaataaacatcattttgtaaatatttatcaagctccaaccgattagttctttccttgattaccgtaatttttgtagagcatgatggcgtgtcttgttattcctttaactagttacgtcaatatgtctgagatatcttatggactgtaagctcttatgcgttccaggtctcccagaggttgccattaatcattcctgataaaattcagcgttcaaaggtatgataattctaactggcattatcaattagaaaccattgttctcataaaagggtcagtgtgtcaaatcataagtccggaatgcaatgagcaactctgctatcaccccccccctttcccatattttcttcatggaaaaatatcggtcaacttaacattggtggaaagaaattgtacaattaatagaaataccgcagtgacagagccataaatgagaaatggttggggccctttttagtgcaccaggagttagaaggagtataggctatatatattaaagagccatagatccttgataatccaccaaaatgtgttatatgtgctaaaatgcagtaaaatcaacatcttgacctctgcaagtatcatctacctggaagactgggaatcatgactgacccaatcaatgatagtttccctaagtttataaattataatcctataatccttgttctgtttatttctaggcattgattgaatgcgatggtgactcgatagacttaagtggagacgttggagctgttgggaggataataatttcaaacagtcctaacggaaatcaggaattgttattggacctaaaaggtaccagcaagtcgatttctttagtatcatttatgtattatgcactttggtttctgactaggcagggtatttttaccaacaagggatttgaaattaatgtccgtgttatcttactacatgcactattcaaaatactttacccatattattattatttttacttatatacttacacaggaacaatatacaaatcaacaattgttccatccaggacattttgcgttgtaagttacattcaaacttaaagtacagttgtgcatttgccttatttgttagtattgatcttaaatccttgatggactgtctctttttctcaggtcagtgtaggacaaacagaagcgaaggttgtcgatgataacataaatctcttatgagtatttgacttctccataatttttagtttaggcagttctactttctagtatgtagcgtgctatttttgctactaaatccgattaaaatatattattctgatggatgtagctgcttaccttattcaaccatttttccccttttgcagatagagtctatcatggatgactttattcaattggaaccccaatccaatttatttgaagcagagactatgatggaaggttagcattcttctagatggtctaattagaaatcttcagcccatatatcctactgtttctgacctataaagctgagcagcaaactgcgcgccaataaaagcagcacatcttatctttctttaatggagctattaagcaatgcattgtcatttgacagtgtagtcaggaacagtcattctgcatgaagtgatgactaatgaccctatcatttgatatgatgataacatctgctgcaatggttattttctaatactccaggcatgttatctttataggtacccttgatggattcacatttgattctgacgaggagggtgacaagcttcctgaaccgcatgcttctcaaaacgatcaaaataatgaagatggggatcaacctaaggcaaaaaccaaaagaaaagctgagaaaccggcagtatgttctctcctacccttttaatgatcctataagcttcttttcagtttcttttctattaccattatgccatctcagaatttaaaactgatgatggcacatgttagtacaaactgtatgaatacctgattcttgaactcctgaaagcgcattacattaccctatataagtttgaaacccaattgtggatagcttttccggaggttttacttatgtactgaagcactttgcctgttttgtatcatgaaattaaggaaccatgctataaactttgcgacatattatagttcctcatgacaaagtttgcttattcttgtgaaatgtaggggaagggacagaagaaggcgaaggttgcaggaaaggccactaagaagggtacaaggaaaacccaaactacgaagagaacaaagaaggcgaagaaatagacctgttgcgaaaccgggacgctaccagtaaagactagagaatccaactccaaatggatcagacttgagaaattccaaatgttgtatgatctgggttatcagtgtagcataatgtacttcttttaggcgtagaatgaaattagaagggatacacatgattgcaaaatccatttttatgtctatgaactctctgtctatcctcatttgtatgttgtataactatcaaatagccaaatttgaaaaagtctggatatcaaacacttgccattcatctttaaagtgattcgagctatttcacatgtgcaaattgaagctcactggcagcaagaacattctgaccactgttgttactccgtactagtattatacattttgctgttctgttttggcaagaagttgcatccaatcttaggctgtgtttagtttagcgcaaagtttggattttggttgaagttggagatgatgcgactgaaaagttgtgtatgtatgacacgttgatgtgatggaaaaggactgaagtttggatccaaactttggctgtgtttagttcagcgcaaagtttggattttggttgaaattggagatgatgtgattgaaaagttgtatgtgtatgacaggttgatgtgatagaaaaggactgaagtttggatccaaactttggatctaaacacagcatttggatctaaacacagccttacggttaaggctcattgttttgtctcagactctcaaacatgattgctggagacccagaagtagatcggggtagtcaacataaaaaacaaaaatggaagatggtcaattggtcactccataatatttttataaatcgacattttttattttggaaatagggataaagagggaaaaaaaaagcggcgtccgcttttcctggatcgggcttcacttaaaaaatcccatttttaaaagtaaaatagacgttgcagggaaaaaaattaaaatagtcactttgtaaattatttttggaataattgaataaatttaaattatatattggcatttttgaacaccaaatatccatttagctcattaacaacggtattcaggtatagtcaacataaacacggttggcaaaataaaataaaatagtaaagtgggtctaattgatttcttgcgctgaaacctactcatccggattagttcaaaacttagcattttgctcgcatttacgactaattattctttcggcgataaacaacatatctgtgaacaacgaagtacccgtggtgacttcatcaatctcaaaatatatcagcctagtcttcgtagaggtgagtgtgcacatcttacgaaccccctacatatatttctgaataataatgaaagaaatggtcccttcatagacgatatactccctctgtctctaaatataaggtattttgcttggatgtaacatattctagtccaacgaatctggacaggaagctgtccatccattatatttaaggatagagggagtactgttttggaaagtaaaatcaaattataaataaatacccttcagaaatatagagagggagagacgagagagagtgaaaaaaaaaacaaaaaaaaaagaagagcggcgtccgcgtttcctggcctcggtcgggctttcccactgcagcagcgaagcaagtcagtcctcctccctagtagtcgaccactgtgtaaatgcagccgcaacacaagggaattccaaggtttcccccaactcaactcccctccccttcgcttcccttcccttctctcctctcctctcctctcctcttctcccccccaaattcgccgccgcctcctctccccctctcctcctacccttccccgcggcggcggcgagaggcggcgcggtgcgtcccctcccctcccccgcactctgctggtgctggtgctgggctgccgttgggggaggcgggagatccgcccgggcccggggttccgtttcctcctcctgctcggtaagcggcaaaccctagcttcggtcggttgcttggatgggggtggatcgtgtgttcgttcgtttgttttaactccgctgtggcttgggtagtgggagaccgaagattgctgcgtcttcctctcgattcggttggtttagtgagggattcatttgctgtttagtgtgctagttagtggttgaatccttcgtgtaggatttagcatccaaggttggggtgcgcagttcatttccgcgacatttttgggagagggggtttcaactgagccccaatgctccgcgctaggtctgtgctcggtgagatcttcgggtgtgtaatgtgtgtgctggaatttgctgctctggttagagatctagaatttctcattatttgttctatgcttttcggtatttgccctgctggttagggcaggcagccaatagatgtactactactttgtttagattacaagcatctgtctttttttacatgcagcggctagtacattttcttgtctgctacgtactatgtaatgctgcttactgtacttgttatcatcatgtccattcagctctcagattaatactgtaatgtgttctttatggtaggtctcaacctgttgtaatactatccatcaccagcaatgaataccccagaaaagaaaccactgtgctatacttctagaagagcactgcaacagaggacagaatcctcttcggaattgatctctgtatcaaaaagagcaacccgccagaatactccacgcaagccggattctcctcccaaacgaacaacaagaagtagcgctaacctggcgaaatgtatagagaacaaacaccatagcagtcctctgaagcggcggcggggttcagatgcggctaccggaaagtctgcaacagggccaacaaggaggaagcataaacagaaaaggaaaaatgatgagagtgatgaggtcagtcgcatggaaaaaagagcaagatatttacttatcaaaataaaacaggagcagaatttgctagatgcatactctggagatggttggaatgggcacaggtatgcactgcttctctcttactgttgtaagcttctgagttttgactatagaaatattcaaatccaactaatcttacatgccaaaaggggaaaaagaaacctgaaattatttaattcatgcttgcatgattgtagtttttgacggaaaactcaaaagcaaaccagattaaaccttctcagtaacaaagttccattttgtttagggcaataatgagcaagggcttagaatgaggtttagaactactcatgaagagaaaatcattcacatttactgtatgcaaaccagatgagaacttatgttttaaccaccaatagcatcttaataataggaggatcagaatccatccctagctcattggctgtgaccaactcctcatgggtcagaaataatactggtatatgtatctgttggaagtaatcattttgacttgcgtagttgaagtagtgtcttgggatagaagtgctttactgtggaggacctctcaatcatgatatacacatctagtttgccttctaattgttaatttgttactgtcagttgtcaattagctatcaaagaactgttctataacggtctatactgatgctctcagtaagcttcacttgtgttgttttatatctaattctctctctctatatatatatatatatatatcctgatgttgcatagaatgaagtaacagtatgctatttatactatacttactaaagggtgtgcctttcctaacagtcgagagaaaataaagccagagaaggagctacagcgtgctaagaaacagatcatgaaatacaaaatcgctatccgtgacgtcattcaccaacttgatttgtgtagttccagtgggagcaaggatgactctgtgattccaccagatgggtgtcacgagtctgtcaatcctgaacatgtatgtatgtcatcaagtgaatatcaaactccctacttccataggattatatattgatacaatgttctcttttctagacaatatgttcaaggtgcaaatcccacgagtcatttcctgacaataacattatattctgtgaggggggctgcaaactggcgtgtcatcagaaatgtttggagcctccttttgataaaagtgggtaatcatttctcttaacttctttcaaaatatgaggttccacctttttggtaaatgaatgtagttttgtttagtgtcaattttttaatatatatttctactttatgtagtgaccagtgcagtgtacgaactcaaccataatctgaactttccaatttcctcaaaaataaactgaacttagcactctactatgttatgttgtggtccaacacttcaaaataaatgtaggacatctctagtgtgtagagtctagactctgctgtcactccatgcataacttgtcttctactttttagcatgtgatgattctttagcatgaataaacatttatatgcctttttaaagaaatgaaagtatggcatgagttcctataaaataatgtatgttttaagttattgcttcagaataatgtaatgtggtgtgctgtaccaaacatcatagtgtaccttctattctgatgattatgcatccatgtcacctgctgcagttgctccacctgatatgttgctgcaatggctactttacagtttgtgatgtatctaactttgttttgtggtatctctcagttcttccaactacccgccatgggcggctttgcaaacactgttcttccaagatgaaaattttagacgccattaatgcccatctggggacaagttttacagtgaagtgtccctccagtgtaagtttttttgttctttacgttcaagttttgatcaccttttagttctttacgttcatgttttgatcaccttttactcaagtggtttaattgtgttgaataagccttgattctgcttgctttctataggatattttcaaggaagcagctgaacatttcaactctgatgatggactgggccaagattggctatctgagtattcaggtgatgaggactatgaccctgaagaaaatgaggccagcagcagtggtgaagagaataaatctgccgattccaattgttcagggagtccactttattctccaaatgatgatattccagacttcatatcagcagatttcaatgatgctgaaggattctgtcgtgaaagttcaaatctaggaatcgattttggtgaagatggtttggctgagattcttacccaccaaaggccaagaagagatgttgactatacacaacttaatgaggtgtgctttatcaacaggaaattgtattctatgaatagcggagtttaaatagatgtgtctgttattaactgtgaatactgtattagtaagttccttttcatcactaagatggatcaacgctattatgaccacttctctccattcacagcaaatgtttggagagcctattggcaatgacgaacagagtgaagatgaagattggggtcttaacaagagaaagaaaagaagaactggttcaactggtgttgggactaattccgtagagggtcgatcagatgtcaaatccaataagaaagcccaacctcggagaaaacttttcaggattcctcctgcggcagttgaggtaacttggaatgtttattatctcaaaaaacatattatcagcattacatcttaattctatgatcgcgtatttgctgtaacacaaaacagaaagtcaattgatggtgaaattcactgatctactgtgcctgtagctgtgaccgtgtgtttttttcaggacacttgcttaatgcctcgtattattctctgttaaattaggtgctccgtaaagcttttgctgaaaatgagcttcctgcccggagtgtcaaagaaaatctctcaacagagctgggtatttcttttgaaaaggtttgttgtgttgtgttgaataatttatttcttacatatgttaattcacctggatattttgttttgctagtcaatttttggcagcactcaccagatcatactccgaagttcaattttcaaaatacagcaaacaatgtgtatgacttttaagttcagatgtatattttgtagttgatcaccttttccttctaatgtgatgggttcatctttgaagtatagaagtattaccaagtttgtctttgcggaatcaatgaactcattgaccaatgacaaatgtctgatctctttgcagattgataagtggttcaaaaatacacggtgtgctgctctcagggataggaaggcatgcatttcttatctcacatttattcatataatctgaatatttgttttcttgcatccgcatgcccccaaatgttccctctgggtttatctatacattccatgtgcccatgcaaacatttgaatatgttgcctgtaaaaaattgaagtcctaaaaatgtattagtagattcattatgtatgatagttactctgagtttgatgcatgatattcatcgactgaaattttgtctttcatgcattacattccttcactatggcaactttacaatctgttatttttaagttcctggcaacatctcacatagtgcccagggttttcgtaagttaaccgttggcattgtctttcagggtgaaagtcgttattctggtcccagcaaaaggtcaagaacaagcatagaaaaggctgaaacttcagctaaagtggatcaaatggacaactcatgctttcttcccttatctgaaataatcaacgtgcccacacgtctgcagaaaggtcttgataagaagccaaaatcaattaacagccctccaagacctcaggacaatgaaacttgcttgtcgccaactgataaaaccaaggtataaacagcaagcgctgataagggcttccacctgaaatagtttactccttttgaatccacccagttaattgtgtggtcttaacttgtctgcttaacttgtcttgtttgcaggagggtacaccgcctacgatcaagccttccatcacagattctagtcaactgatgaataacaacatcggcactgaggagactgctgtttcttgggtggacacttgggcctctgacgctctgcatttcttggacgtgagcgatgatgaacatttcttcgatgtgatcgagaaggtgtgcggtctcgagaatcggctgcagcggttgaaggagaacatgctatcatcgtcatcgtcaactgacaacaatgtggctgctgagagtggcttgcaaaacgaagttgtgcttgtaccagctgctgagctcaaggataaagcatcttaaccttgcatctgggtcccaatgctttgcttcagttgaccatttgctcataggattttatacatcagaaaatagtacaggaggggctggagtgtagcttgccccgtttatctttgaacttatataccggtgaactggtaccattctatatagggagggacagataattcggattaggttcgtgaggatttgcaaagagttagtttaactgtaatctttcagctggaactttgttcagcgagtaataggtcatggacaattaccaaatgcatgcgtaattctcgctctctgtccacaaatgtagcgaatatttttatttgtgcatgcatgatatactaaactactctaattgacctctacctaattagatagcattcgttaagggtatagaggaaccaatacacacttaagtttgaatgtgaatatgccttgtatttgtggacggagggagtatcattcattccatagtactaaacactaccgtgattttgacttttttttcccttttactgctaccgatttctccaataattttacataacacgggtaacaatgttttcgcttcaatttacatgcacctggaactgaaacccataagggcatacaatcatttcttagaatagttcatttaaagggtaaagtaattgccatacattcacagaaatggcctttcaagtcacatgtattctgggaacgagacagggcaacaaaacagatatttgtacagcgaaaagatcctaatccttttcaggtgagtgattagcagcaatctggttagcaagcatacaagcacagagagagattaaattttaaataattttagagttaattttatttttttatcatagtttactttttaattagctaaaaaatacctaaatttttttaatcgctaataagtgttacagattatagtcaactataagcaaaacgatggactcgtactgctaattggataagcagcaatcccctgcaatctggtaatgataagagtgatctgctggccggtcacacctgcacggttcatcctccctctactttttagcggccatgatccgtgtgcctcttgtgcacatacatttagcactcatacattgcattatccatagcaaatggtagatggattagcaggccaagtgtctcaatttctcaccatccatccatctgatgagagagagagaaagatagtcagacaaatctagagagagaatagtacagagtgacagaattgggagaggagataagatgggcagctcatgggttttagctgatggtgacagtactttgcccttttcctgctagcccagggggatatgtgcatatttccctttggtttggacccttgtgaaaacgtttcacactgattgatgtaatttgctgtacgtttttgttcgtttggtgttttgagttcgacagcaacactttgtgcatcagttggtactacagttccatgcaaatgccggccaaacttaccacctcttatgtctggactccctttaaaatgtactatgaacttcctataaaatctccagtatgtcccaaacggttattaccgagggtttttaatctgaatgagtatatatattactacctccgtcctaaatataataataggaaaaattagatgtatccgtcctaaattgatttcatgtccagattcattgtccggaaagagtctaatcatacgaagattgttatattagtgttgactacaaccatctcacgttgatcacaaattacttctaaataattactttatgatgaatgatagtcgttgtacctttatatttatggcaccacgtacctttataatttaagcttgaatagtaacagtgcaaattatttgagaatacaggaagtatattgcccacaggtttgggctgcactttgtcgatgagctcaacctttcatcagtgtaaattatttgagagtacagtatagctacagtgtattgtacgggctgcaggacaaaataaacagtttgcaattccccaaacccagatgatgtgtacagaatacagatccaagaacatatatatacgtatttgtatatagtagtacctatatacacatatatcctaacactttgaactgcagtctagagctgaactgcagatgtaccgtatgaacggatctaactgcatggctgcagcaggtgcagggaaagaaagaggaaacactgtattggtgttttggtcagaaatggatacgtgtccagcactgccatgtcctgtgaattttggacctgaggccttagataaaaaaaatttagccaaaaacgtcccatcaaatatttggacatatacatagaatattaaatgtgaaaaaaatcaattacacagtttgcatgtaaattgcgagacaaatcttttgagcctaattacgctatgatttgatagtgtgatgctacagtaaacatttactaatgacgaattaatttggcttaataaattcgtctcacagtttacaagagaaatttgtaatttgttttgttattagtctacgcttaatacttcaaatgcgtgtccctgtgcttcaaaaactttacacccaaaaaaactaaatacaccttgacaaaatcaacagcaaggccgagtttagatccaaagtttttcttcaaactttcaacttttccatcacattaaaactttcctacacacacaaacttttaacttttccatcgcatcgttccaatttcaaccaaacttccaattttggcgtgaactaaggcagtgtttagttcccccaaattcccagctttccatcacatcatatcacatcgaaaactttcctacacacataaactaccaactttttctctaaactaccaactttctttcaacttcctaactttttcaccatctaaacacagcctaaacacacctcaagtccgtgtattcagtcttgttcagaggttaaattttcagaaccggcctagggccgtgtttatttgtttcggaatttttttttacgtgtacggacacatatttgaagtattaaacgtagactaatgacaaaacaaattaaaaattccgcctgtaaactgcgagacgaatctattaagcttaattaatccgtcattagcaaatgtttactgtagcaccacattgtcaaatcatggcgtaattaggcttaaaagattcgtctagcaatttacatgcaaattgtgcaattggtttttttcgttcatatttaatgcttcatgcatgtgtttaaacatttaatgtgatagaaaagttcaaagtttgaagtaactaaacacagcactactccaaattcaattggattctgtagatatttatgtccagcacacctctcttgaaacataatcatcatctgtagatatatccagcactttcaacttaatttgcttgatttaatcaagtctcttaattaatggtttagtgtatcagtatatcaccggatggatggctaattaattaagattctgctaagctaaggtgataagcggtagataaacaactaaaaataatcagaaatgacttgtaggtcaaatttctatgagtaaatttcacaaaattataggtattttgcataatttatcacaaaactacagatttaagagcttgtttcataaaactacatatttagtgtctatttttatcacaaaactataggtactttgtataatctatcacaaaactatatatttaagaacttgttttataaaactatagatttagtgtattcgtttatcccataactacacatttagtgtcttcttttatcaaaaaactacatgtttagtgtcttcattatcacaaaactacaggttttaacaatgctaaaacatgtatttttgtgataatgaagacactaaacttgtagttttgtgataaatgaagatattaaatctgtagttttgtgaaacaagttcttaaatctgtagttttgtgatgtattgtgcaaagtacctgtagttttgtgataaacgtagacactaaatctgtagttttgtgaaatatattcttaaatatatagttttgtgatagaatgtacaaaatatatgcagttttatgaaatttactcgatttctgtatacataaatctctctcactagacgtaggagtaaaactctctctagagatctctcttgctcttttttttttctctcgttgtcgtatagactagtagtgtggtcacacacaccaaacaagcatggcaggcatgcactgttgcagcaagaacacaaggaagcacggtcacatgcatcgattggtgtgaccatttggtcgcattacccttcatccatcgatctgtacacacctcccatggatatatatgtacatcgatctatatatattggagtgtatgcatgcatgcaacctagctacatatccatgcatgtctcaacaaattgacacgcatcgtcatcgacatcaatataaacgcatcgatgcggcacgcatggcatgcatgattatcaatatgatatgcataatgtatgtatgatacatgcatgcacatatcgatagaggttaaagcttgaaaagctaagtgtcactgaggaaatatttttttttatcacctgaatagatgtacacccgtttattatatgtaacctaaatagttatatatatttttaaaaaaattgataagatattatattaatatgtaatactatatcatttcatgaattcgatttttataagttatataacataacaaattaaactctaattactatacatatatccatagtcaattttgtttttttatgacttattgacctttattttctttaattacttgataaccattcagtttgcatctaataaatgagtagatgaccattgaatgtttggtgatccaacgtgacgttacgaacatgggtgaaaactatatgaaaatttccgaccatactgacacaccgtttccgcaaactaatagtatatataataataatatttttatcgactgttttaaaaattcagttttttataaatataaaaattttctgacctttccgatcgtttttgtaaaaataataaaataatgataccgtttccacccgttttcttcccctagttacggctatctgatatcgatctgcaatgcacacttgcacaggtcgcaatctccgagtgccatgatgcgcgctcgtactgcactttgcttggatgtttcttccgaagaaatgcacggcaaccagatccagattatcgtacagtactagtagccctgcaaaagtaggagtaacttgtttttactcgtgctgctgcattgcatatgcatgctagcttaattggcaccacgacgcattccctgcacaaaagctgtaaaatgcttctactcctcgatcacctctcgctagattaggctcttgcatgcgttgccatcggatgccacaccatatgcacagatgccgtgcatggatccgatccttgtagttagtgttgtgcgtctaacatgtgagcctttattgttctttgagtcaacaatatgacgacaataacaaaacatcagtaatggtttttaaagatgataaatagaatttcagtctatatttatgtcaagcacatcggtaacggtagaggattgtaatcccataattaagcttatggagaaagaagaagaggtacatgcccttctataaggacgatagtattgcatgtgtcacatttcttaaatccctgaaaggatacatactccacagtgcaggttatttttaatgggtcacactagtatctcctcccctccccctctttgtctttatccaccggtagaagaagcctgcggagcgacagcccaagtggcaataacgtcctcaagtagcaaacactaggcagagcagaggcggcatcaccgcctcttcattggggccggaagccgcggaagaagacgcggacaacggcgccaccgagctcgcccaaaccgtcctagggctcattggatctagcctcaggcggtggtggcagctcagtaccaacgccacctcacccttctccctcctcgcactagttccaccctccctccaacccgccttcaactctagccgccgccatcgcctgtcgcctcttcgggctctccaagacaaggaagcttccccgatctcaggtgccaccactgtcccctcctcattggtcgggcagatcaggccgtccctttcaaagccgatcgaggtggcagcggtggacatggagctcgacggtggtaaatctggtgtctagtagtagcagacatggagcttggcagcaatggcatcatcgtccgtgtcacttcgctaggtaatccctccctctccccccccaccccccacccctccctcccctctctctctcctggtttttgcttcctatcatgtttttttttttttgacaatgccactagttccttgtagggagacacattcttcgtcagggtgagcaagatggcaggttaagacactaatgttcgctaggtgcgctgaaaaatgcgataagatgtcaacagggttaaccttgtgcagggcacgatcgagactgcgtgcatccctgagagggtgggcgtcagagaggaagtagttactgcgcacgcacagacacacatgcatggttaagtaaactgtcaaacaaaaaatggagatggtgctagctggagcagctgcatatatcgtccgtcccccttgaacatttcgggaaagcaggatcgcgcacgcacgcacgcgtcacgccgcgcgcgcgaccacccccacccttccttggctttggcttggtttggcccggcgcgccgctcgcccgcgcgacagcccgtacgagcagaaaaagggaaaactgcatgttcagcagcagcagcagcagcagagagcagacgacgacgagatgagcgtcctgctcctcctgcccatcgaaatcgactgatcctcttcttttcacaagtccttttttcgcattgcacaagtcgtcgcgaccccaaaagcaccagctctagttttaccacctgctgttacctactccctcagttctaaatataaacaaccctccgtacggattcgttgtactataatgggtcacatccatcctagattgtctttttttagaacggagggagtagctagcactagcagcaagttgcaattacgtgcagaagatgcatggtgtttttttttaaaaaaaatatagcaccattaatttttcacataaagtttaactatttatcttattatttaaaaatttataaggtaagattatagtttattccatgacaaaacaagttaaaaataaaaaaatttattttttttctaataagacaaatagttaaacatcatataaaatatcaatggcatcatacaaagctgcaaactaaaaaaaataagggagcgaaaatggctatctctgcactcgtgcactgtgagttgttttcctttttattttctaatatctgttgatgttggtatatgtattgacacactatatataaacccaagcagaattccaaggtatttatcgtgtgtgtggttcatgttttctagaactcctccgacctgtcagtctgtcacgcacatatcatttctaaaaaaataatattcttttaaggaagaaaaagaaaatatcaagtccaatggcactatattcatttattaatttgtccattatatataaaatctaaatctttccccttcatgtttttttctggctcctcttgttttcttcagtagcttagctaaaatctgaaaaattaattatcatgtccggtgcgtcgtgtggtaccaccattcggcaaggtctcgtgtcatgcttgattcgccatgctacacatcttaattcgtttggcactacagtgacaacaaaccataccataggacatgcatatctctctctctctctctctctctctctctctcatgcaaattgctgctaatataatgcctagctacaaatatctcctaggtagagggacaaattcatatccaaatcgtgtcctttggataaagtccctagtagtacatgagtagcacatatcaaatatgctttcttcatacatgtatacacatggcatgttatatgtcaagaaaaaaatccattttactcccccgaacatttttacggagcacttaaccccctcaacaaattattggctcgttttaacacttcaaactattgaaaatggttcaccttactagctagggtttgaaatttcagtaatttcaggcctcacccgcaaacacaaatctccccaaaattttcattttttgtcaaatatttataaatttgtttaaattcagtcaaaaaatgttaagatttcaaataattttggtccgaataacctggaaatcacgaaatttttaattttttggtaaccaccgaaattgaaaaccttgttactagatcccaaatattattttttttcttttcatctctctctatataagtcgtactttgcaatgcaatttagtagaattggtatatgcatgatttttttttgaaacctaagcaaaactttgttccacttttatatttagaagaagagaattggtatatgcatgataatttacctttcaatactttttcatcgttgtttacataggttggaagcactaagactaatttaaacatacatgttttaaaattcaagctaatagtcatgaaaatattttagaactatgataagtgatccaacgagatagtttgggtgagtaaaatgttttttctttcatatatcaatagtactagagaaaatattgtagtttggagtcgtttctcgcgatcgatttttcgggaagatgttcggatatatgtcgacaacaaaggagagccgtaaaatgggtcttttgccaatggagacaaagggacaaaattgcttcaaaatagccggcgagcaacagcacacatctgtaagtacgttctaggtcacctgcagctgatggggatgagccctatccttaactgtgttgtatctactatacgtagatgtacacgattggttggtacatcctggccattcaagctggggaagattaagtgctgtgttggaactttggtggcaacagctatagagatatttatcttaaaattagtcaaaatactgaaatatataaaagatatatatggagaaacacacaggggtccgaagcctcaccccttctaattatttgatattaggacattccctaatattcgcgtctttataaaagatatatatgcaagagtaatatatattgcatctatatgtagctaagctagcaaacacttaaaatatgtggtattactttgccccctgtatcctattgccatttccattaatttgttgtatataattatgagttccaataataagaataattttctaaaattaaatcatgacataattatctaattgcataaataatccaattcccattgtcaaactagaaaaatctattttatatttgtgtaaagaacaaagcgtgggctgccagccacgaagagacacttttgaagtaaaaataaaataaaatatcttgcaaaatatccagccatgcctgtcctacaaggacccaaggaaaaacctcatcctaaacaagagcaaaggattaatttggttggccagaaatggctcaaatggcccctcctctctatcattagtggttgaaccatggggtcacaacgtatggggcatggctaccacacatcctaattctcctattcataaattttaataagaacgtcgctttgcgcacgcacccgataatagcccgtggtttccatcaccagatgacaatatggccctactggctgacatatttcaccggacccatctctagctgaatatcgtgatgtaattcctcacagagatagttttatgtcgaaagtttttcttttctgtcatgtgaagcattatctctgaatttaaaagggacccaaatcttgcaacacaaaaacaaaataggaagagctttatttgtgcatgtaacagtaatctctctctcatctcatggtgttgcatttggggccaatcatggtcagccatggatgcgaacaagcttccaagatccggtgggacccaccctcctcggcatctcgtgaaaaggttgccgagccgataaagagcgtgccacgtgtgcagagagaatccggggagccaatgggagggcgccacgtcagcggatagggcaaattatagtgggtgcttttccgttgggaggtcagtactcacagtagcctagttgaggggtagatgggatgggcaaccacaagaggcctctgttgtttctttactgaaatgccccttgttgttcttgcttttgctgttggtgtgattggaactttgcactggatactttttgaggtagattgtctcttaattttaaggcaaatctgtgggcaaatgttttggtgactgtaaaattatgggcggttcattttgatgttacttttaaccataccatttattggcaaacttgacaaaaaaaaagtctacgtttagtttgttgccaaatttagtaaatatataagaaatcctgccaaaattttgacaatattgccatcttaccaaaattttagcattatcaaaatttggttagatttattttggctacaatctaaacaggcccgatagtagttggcaattaatttctccaaagaattttttttcatgtaaatgaaacatgcttgtgtgcatcaatagtctaattcaatgtataaggaaaccatatgcaaggccttagtttaaggcaaagctgtgggcaaatagtttggtaatcatgagtcgatagttgacaataattcacttatgttaagaaaatactgtataaataaaacatccatgttcatcaatactctgaattttcatatgtttatcaaacttaagcgagttgaattggtctaattcaatgcatagggaaaccatgtcgactccatttttttttatgaaacatgttgattttatctcataagaggtggcaccgagaatgcaaattttcacttgtcagattcgcccatggatacaagtttaaatgacaacttgtatcaaacttttaattttgtgcgctggtatttgcttcttgtcggttagacctaatgtgttgtcatctaaccaaaaaagagtagaaaaggagagaactgcatatcctgcataaggtaggaacatgtactgaatctgtcgagacattcgacaaaaaatatgtgtctaattaacacctagtaaatgacaacaaacttgatcaaacaaataatatactatacttgcataggagaatcacagttaaaaaataataatataccgattgtttctaggagatacctaatcaatattataacgtctctagcatcttcacacagacgtgtagctagcatgagacaacctgcaggagaagtgtcacttgacatttcgccaaaaacatatggaggaatgcttcagagctttttggttttcatccagcacaagaagcatggagacaaggtgcactggtccaaaatactgtatagaataattgagttgagtaatcttttagtcccatgattcattggccagtgccgtctctacagagtaaatattgattaggggaacgtttagcaacagccaacagacaatcaggaactacctaacaaatagttacctttgtcatgtgttccaataataaataaatgagaatgaatcaatcataaaacctaattacatgtagggcatgtttagttccctaaaaacttttcctaaaaacatcacatcgaatctttggacacatatatagagcattaaatatagataaaaagaaaaactaattgcacagtttgcatctaaatcgcgagacgaatcttttgagcataattaggccatgattagccataagtgctacagtacccacatgtgctaacgatggattaattaggctcaaaagatttgtctcgtagtttccaggcgagttatgaaattagttttttcatttgtgtctaaaaaaccccttccgacatccggtcaaacggccgatgtgacacccaaaaattttcatttcaccaactaaacaggcccgtactaattaactatagattacagcctcctcaaaatcatgtatgttaaccctaaatattgtccacttttttttgttaaatcttgccaacatttatctctctcttctaatatttcacatttgattatttcccccaaaataggacttataaatactatgtacttcatgatatctaaagaatttttaaaaaggtttttacaattaccaggtgagggtgatgaagttttcaacactactgcctagggcaaattggtctcaattatactaactgcaaatccagatgccccaaacaatgccaacatatgtacaacctagagagatgaggagaggaaaaaaagagcacaaagaagatgtggagagaggagggtggcctgcacaaaatgcaagtgtgggtccagctaatttgcagtgggtcccacaggcaggggggaaggaaagggacccaatgagaggaggcttgtctcttcctctagccttcttccttctccctctaaaaccccaccccctcctcccttctcttgaaccctttcttcctcctccctcctccagttccccacatctctctctctctctttctctctctaacccctctcctaccatagtactaccatctctctctttctctctcctcaactagaattagcattgctgctctgctcatctatctccaatcccaaaacatttctcaattcagctcagagaattctcctcctcctgttgctgctctgtgcctctgctctgctccttgacttcttcttgccacacagcagtacagctacagaagcagagtcttttcaatccctcatcttttccaaggtgttcttggagttgaaccttttttgcctttggagaatccccaaggttgctgctgagctttgtgttgcagtttgaagtgaagttggaacacctttcccaaaattttcattttttggggtgcctttttcaccttcttgtcaatcttattacaaggcatcagaaagtttcagaggaaaggaaatttttcccagttgttttcattgcttttggagagtttggcagccttgagattttaggggtttaggcgtttcttggacgaacacctcgagctcttctccatttgcagcttgccaagaagctgatcggccattgcaatgtcgtcttcttgcataccgaccggcctgaggctggacctggacatcgtgaaggcggcgacgtcgccgggcgcgcactcgtcgccgctgcggccggcgcactcgtcgccgtcgtcgacgctgtcggaggcgtcgaacacgtcgtcgtcgtcggcgacgtcggtgtcgctgaagcgcgccagggcgccgcggaagcggccgaaccaggcgtacaacgaggcggcggcgctgctcgcgtccatccacccctccgtcttccccgtcaagaagagccccaagacggcgtcgcggccgccgacgaggcagctctccggcttgtcggcggtgttcgacccctcctccgacctcctcccgccgctccccgtcctcgccgacgccgcattcctcctccgcgacacgccgccgacgccgcggcagaactgctcgtcgccggcgccggtgagcagcgctttccgggagttccgcgacccggcgccgctgtcaccggcgagcccccacaccaccgacgagcccggcgagctcgacttcgacgacgactgcttcctcgacgtcgacgaggccgcggccgacggcgcggccgggggcatcgacggcatcatgggcagcctcaccgtggagaccaacacagccgccgccacaacctccgacgactccatcctctccagctccggcatacacccttacctcaggagcctcatggtggtcggcctcgccggccggttcgagctcggcctcggctcgcgccacggcgcgcggccaaacctcaaccgcgcgctcaagcggcgcgacgacgacggcgcgtggtggatgtggccggccgtgccagtgaaagacatcaccgtggcgccgccgccgccgacgccgacgccgacgccgccacggccacaggggacagcgtcgaacaccacggccgcaatgccatcgccaccatcggcgccggagaagaagaagagcaagaagaagaaggtggtgaaggtggagaaggtgatggcgagggagaaggaggaggaggagtcgccgcccgacgcgaggtgcaaggaggaggaagccgccgatggaacagtggacgccggcaatggcgacggcgcgccgacgatggcgcccaagaccgggttggggctgaagctcgacgccgacgacgtgctcaaggcgtggtccggcaaggggtcgatgttcgccgacggcggcgcgccggagtcgcccaagtcggccgccgaagtgcgggtgagtaaatgaattcactcaaacatggcaaatattttccatataaaaatggtttattaaaataggagagtaaaacataggacacatatattatatttgatgaatgaataaagtaactcaacttctaaaaattcatatttgttctgtacggagtgatagctcattcagtataaaaaaactcatttagtataagatagatttggcacaatttttagatgaaatttacctcttccatagcattgttactcagattgaagggacatattccaagcaaaaaatgaacagatgaactctgaatatgttttatggttaacgtttttattgcagttgcataacaagaaagaatttatgtcatttgtagcttatttagttattttcacctccgtttctacaattcttctaataagaatttcttttagaatgaagatacataagttgtatatccaaccaattgtttcctatagtgaaaataacaaggaaagagccagtaaaacacgtgttcgatatgcaacagccacttggagaactagcctctgatttggaactgtttatccaaaaggacggtccctcacaagtcacaacagtacaacactatagtactctagtacatatttgtaagcaagcaccttttgtagagtttcactgatactgtctccagtaatccataaaaatggatgtattcagaagtgatgaaattctgtaaaaaaaacaacacctagatagtttagaggtttgaagtaaacctatgcagttaaaatgaattattcaacaatggaccacagacaattgggcctggagatcgtctgccatggattacatggttgtcttcttgcaaagagtcatttgggctcaaatctttgccctctgggccagtgatggagcatctgcaacaaactccagccccaattcagttggctttttctgcaatttgctctcacaaatggcaagatttgcagctgtcataatggggaaacataaccgtcccagatgtgtccggcttctatgtagtttggacacactatgcattggcatgtattgctactatgagaaacattataacgatgattcaaactgtagacgtaatttgcatctctttcctaggattctgaatgaaaagaagcacttacagtctttttttactgctggtgcaggctaaacttgcagatattgatctgttccctgagaatggaaatggtgctggtggcatcagggaagccagcgtcatgaggtacaaggagaagcggcgcacccgactgttctcgaagaagatccggtaccaggtccggaaggtgaacgcagactgccggcctcggatgaaggcaagcactagaactgattcttgaaagcataaaaaaaggtccatttaattgtaaggcaaaaaccaaagaactcattgttcacaacataatacccccatttgtttcacctagagctatacattatagcactatcagagcagatcttgcaagttactgatttgttgtttctgtgcttggattcttgcagggaaggtttgttaggagcccatctcttcttcaacaagtcctggaggaagagagctagacagagtgacagacagtgatacttgctagccttttttatgagcaccctttttggccttttagttcctcattagctaagagatgtgatgagtgaggttttattttttggctttgtttggagttttgctttggaggaagatagagaagcctttagaatgagttgtgatggaggatcacatagtttgtctcaggtttacaatgtgcggtaaaaaaaaggaaggaaataaagtgatgttagaatatacagttttttaatccatttctacagcttcaaattctcgattgagcggcacgttctttgaaatgttcatagcaaagcaaatcaaacgaaatggatgagatttgaaactaagaaactgcacttgacaaagcacgctgcgctctctgaaattcatgttcagcagaacgcctttcagaaattcatgttctgctgctgcaggaaggcagctaagaactccatgcaataaaaatataaaatgcagtgcagttattagttagtgtagtagtaatctaagaaacaacaggtttaacagaatattaccttcaaaaacatcccctcaaatcaagactcggaaatcaacaccattctgaaactagatgcaatactgcgctcctaatggaatcttcagtggttactcctacacgccactaaaaaaaacgggctttggaaaaacgtcaccctgaaacaaaagctcagtaaaaataccactctaaaatcttgcagcatgcaatatcacaaaagcagatcaatccgtaattgtatttatgctgcatataccgtgatattttctgtgatcctctgcactatcttcagctcatcagctgcatattttgaagccggactgatggctcatcgctttgtttcggcttattgtgatagccatccatgcgttgacgaaagatttagatatatcacaattttaaccaagttcagagcaatgttagctttagctgatgatatacacggcgcactgattgccgccgttattttcagagccttgtaaaacctgaaacaaattgtgtctccaaattcttactagtactgcagacatagcggatttgttttcaggatgaattatcacaaaggtaagtcaattcatagccatattacgcaagttcaaaactgcaggccacaccatacgtttctgaaagtagaaacaagagatcttgcagcagatcaccactaaagaagcagtaaccgcaaaaaattataacataatccagaattaacacttcgcagcattactgaattcactttaatagcacttctcatcatgaactagtacaacaacataactgtccagtggaaatgtgaaatgcatacaccaagtaatggtccataacatgaactatatggatacaacaacgttcttatttcgctcatatatacatgaaataagtcttgcacgtcttggttacttaataggtgcgataatcgccgtaggcttttagaagaagaaaaaaaagtgagcctgcaaagttcctggggacagttgaagatcatcgggcactcattgctgcaacaacttcagggtggtagtggagcatctcgtgccacatcatttccctgatcatatctgcactgatgttctcgtctatgtccagatcgataggcacttgcgcgggaggatttgcacttggatcatacagaggggacatgtaagggtgctcaagagcctcggtgacactgattcttttggtaggatcaaatatgagcatcttctgtaaaagatcaatggcaagagggtgtgcatgcggatacatactcgcgaggggcacaccgggagtgtaggggagggatttgatatatctgcgagcttttgggttgtcaatgaactccaagtcagactcgctcatggtgccaagaacattgacaatgagcttgagctgatttaggcactcagttcctgggaaaataggtttccgaccaagtagctcagcgaagatgcaaccaacagaccaaacatcaatggaagtgccatagttgtcacagcaaaggagcaactcaggagctctataccagcgggtgacaacatactcagtcataaactgacctttactactgtttgtgcgtgcaagaccaaaatcacatatcttgagatcacagtttgcattaaccagtagatttccaggtttcaggtctctgtggagtatctctgctgaatggagatatttcagtcctcgaagcaactacaatcaagaaaacaacattctcttaaatcatctggaaaatacggattgcaaaaaataagaaatacatggtagacaatccaaaatgaactcaagacaacagaataaatgaatctgaagggtaggatgaacagacaattcatcagaaaaatatttatgtcttgtaaacaagagggtctacttgtgtggtttcatgcagaagcctctatgcagaactatttgaaagaagatctaggttttagattatgaactgtatatgaaattcttaatggaaatgtggtttaacgaaattaataaaataagttagaatagatggaaatctaaaaagggctagatggttccagttccagttttaggttgaacggacattagaatagctgcttttttatgtacttgatgaggcaacaagggaatgcatggatgttgtgcctgtgacacatgaaaataaatgttcaactctacaaattaaaataaaatgtataaaaagaggaatcatgatggcaatacttaatgcacaaagtgtgtagtttagtttgtctcaaagctgcagactacagggatatagttttgccttccatctatttattatcagtctaaactgttggaatctgggttggaataaatatagtaggccattttttcagtttttttcaaatactactaatgcaaaaacatcaaatcaactggaatcaaactgaatgatactacaagttacattggttatttcaaattaggaatacattactcaaaaaagtattgtcattgacatgctcacaaatcattgctgaagcaaaacattcacaattttacatgtttaaaaaatcagtttgactttgaagttttaactgacagaagaaccattcaagttaagattgtgcctcgtgcatttgggaatgaaccatcttataagactggatgaggcttgccgatataagatgcactgtcacaaattctaagcaatcatcaagggccattaaaaacacacaattactcttgagtaagtaaatgtagaatagaatagaaaagagaggtccaggtattacctgaaaaagaaaatattggcagtgatcattggaaagaccctgaggtgacttgattatctgatgcaggtcagtatccatgagttcataaactaagtacacatctttaaaactcctcctgtgtactggcatcattatatccttcaaagcaataacattctcatggcggagatgccggagaagtttcagctcccgcaaagtccttagtgcatcaacacggttgtcaaaaacattgtgtatcttctttattgctactttctcgttggtctcacgatttatggatgaacaaacaatcccataagctcctcgcccgatgggcttgattggcacatacttagtgtctatctcaaacaaagtttgccacatcgagtagtaatacttcccttggttacccatcccatttggaggatccaccatgatcgccatttcctactaaggaaacaaaagaaaataagttagtactaccttaggaaataacaacggctttttgagcttacacaactgccaaactatctatgaatgcagaagatcaaacaactttgtaatcaaagatgagctataaattaaacgcagtcccagtcttcaagatgagctttcagttgctcggctatggttctgaatgaacatggagcatcgatccccgcacactcatacagatgctccatcaccaagcatgcattgccgcctgcatttatctcctcccgcctttagaaccgccatggtggtggtaccaattcccaatcccggagaaagacatggacacccatcccacggttcatggatgcaagattgtgaatcatcatcactcatccgggtcaaccaaacaacccaccatcatcccgatacgagcacacccccatcacatttcccagctcatcgccacggattgtgcagacagcctcaccacccaaattcaccaccggagcacaaaaatggccggcaaccaaatttacacacagcccaaccaatcacgcgcgcgtaatcctcccacggagctgagcttctccagctacacagatcaacagagagagatcgatccatggagcccggacaaacaaaccacccgccgatcttggaccacgaccaagaaacacccagccagaacagtacggtcaaaaaaaacaaaaacaaaagattcccctcaccccgagacaccgcgagggagggagaggagcgcgaggccgagacgggaagagcggatcagatcgccaccgcctccatcgccgatcgcctcgctcgaattcgtcgtcgtcgtcgtcgccgtggccgcagccgaggaggagaagaggagaagggacagcttcccgtgaggtgtggatggggaagaggagagaggtgggggaaaggaatattccccgtggggggaatctgcagccgtcggttgggcggccggtgcgatcctggccgtccgatcggtgcggcgcgcgcacgtgtgtgtttgtgtgacgtgccgaccaacgcggcgggtggtagtggtggtgatggtgagtcgtcgtttgcaaggcaccggccggcggtgcggtttactggactgggttggtttggtttgcggcctcgtcttttgatttatgtttatatttataagtcaaaactttaaatttaaaattgatttttgggttctttttatcataatttatttttagtattttttagataaaaaatatgtatatatgagttttatttataaattatttttcgtttgtaaatatgttgttttacgatggagtcttttggttggactcctcgcttggatagttggtttgatggtggatggatagtcgtcgatgtctgagtgataaatcggtggatggatggatggatgatggattgtgtgtggtatcgttgattggagatcggaagaggaacgggacgcgctgtgggggaacagttccatgatttcttgaggtgacagggctgtaatgacaagaggatttggattggtttcttggtctacgcttatgagcaatgattttacctgcttgatttagtgctatatgtacatatattactcagttttgtttgattatatgtgatgtgagacagtaataatggtgtgtttgaggagaagaagattggggagattggaaagatatgcaaaacgatgtgagccattagcgtatgattaattgagtattaactattttaaattttaaaaatggattgatatgattttttaaagcaactttcctatagaaaacttttgtaaaaaacgcaccgtttagtagtttgggaagcgtgcgcgcggaaaagaggttctttctcatcctatatcacacaaaagaacgcagcctaagtgtagtggtatactagcacgattgttcatgagaagtgtcgtttatacttaattacgtatgcgtactaccttatttttatctaaattttatagtaagcattaatatttttatcaaaggcactaaataaatttagccgtatttttaactcttcaagatactttaataactctatgctgtatatagaaaatgtatcacagtgataatataaaccttagcctgactaggatatcataactcaatgccacatatgataaataaagtataatggtgaatctctagtttataaatggcaaacacttattttgtattatccattatccgtatagtacgttatgtctccattaggccttgtttagtttccagaacaaaaacttttcacccatattacatcgaatgtttggacacatgcatggagtattaaatgtggacaaaacaaacccgattacacagtttgcgtgtaatttgtgagatgaatcttttaagcctaattgcgccatgatttgacaatgtggtgctacagtaaacatttgctaatgacggattaattaggcttaataaattcgtctcgtagtttcctggcggaatatgtaatttgttttgttattagactacgtttaatacttcaaatgtgtgtccgtatatccgatgtgacaactaaacctaaaatttttcccaactaaataaggcttagttgaagtttgaagcattttcatgtgccttttcttcgtcaacagaccaaccaataattccatttaaactttttttcacaagtttctcaaaaagaatattcacttgttgttcatcaccatcatatgcaataatacaaaaggaggaaaaaaaaatgaaaaacacatggctcaaaatacattcacgaatttgagagatcaacaacaccttgagaaaatgacccaaaaaagaaagaaaaacgtggtttataaatggcaaacacttattttatattatccattatccgttatagtctgaactttcatgcattttgactttaattttttaaaaatacccatgcattttcacgtgccttttcttcatcaacaaaccaaccaataataatctccttaaaactgttcctttttcttcacaagcttctcaaaaagaatatgctctttttatccatcaccatcatatacaacaatacacaggagaaagaaaaaaaaatgaaaaacacatggctcgaaatacattcacgaaattgagagatcaacgacacctacaagaaaagggttaattagatacaagaacgaaaaagaggggaaaaaaaaaacccgtcttcttccttgctcgtctcgcacctctctccctctcgatcgaacgaaccgacacctccgcaccaccaccccaccaccaacccgtgcccacgcacgctaacgtgaaccgcgacgaaatctcaaaaaaaatttcgcgtcaaaattcctcctcctccccgaatcccccccaaatccaaacccccagattccctcgccatttttccacccgcgggaggagtcctcagatctctctcccccccgccgccgcggattggcacgcggccaccgagatccttcggttcgtgagcgcagatttggttcgggggttggtcgtcgcgctgggggctagggtttggcggaattgatgctgcctaccagtcttgcttgacccgctcccggggagagatctcgccgcatggatcgcaagggcggcggcggcggtggcgggaacaggaaccgcactgatctcctcgctgctgggcgtcagaaggtactgaatcccgcgagctcgttgttgtttttgatgattttttttttgaggtttttttttgttttgggtctgatcgagtgttgggtgccatgggcgtgcagctgcagcagttcaggaagaagaaggagaagaggggtcctggtaagaaggccgaagccaaggcggatgcggcggaggctgaggagggctcgtcgaagtcgggggcagacgcggaggaggccatgccggagccgaaatctcccgttggattgaagttgctcgccggtgagggcggtgctagtcatcgcacgccgtttgaggtgaagcttgtgctccttctgggtgggtgtgggtgggggtttggatcagtgcttgttgtgtttaacactgatgtttcaatgcaggaagcggcgaggtcgcaggtggagcaatgcaatgggcaggggcctgataccgcggagtcctgcgatgtggataatgccgatgtcttgcctgtacaggagggtggtgatggtggtggtaatgcacaggatgtaggtgtaagtgaacatggcagtttagagcatgtaaaccctggaccaggtgatggcgaaggtgcaacgatcccggttaccggtgcagatggttctggccttcttatagaaggagctcagccagtggagatggatgttgatgagaaactgccagataatagtttaaaggaaaacacggagctgtgcacatcttcccaaggtgacatagctgatgataatggcgacagccaagcagaggaacaccagcaggtggagatgtaccctgttgagaggccgaccagttctgattccaaagaaattacagatatcattggtcactctcaagacattggagctggtaatactaataagggggaaggaagggctagagaaacggagattgatgtttctgggatgccatctggtgctgtggtagagtgtgaaggagaattgaatgttagagcttcacatgaggcttctgagagtacttcaagagaagacactgacaaggaagctgatgcactgggggaagaagctgctgttcaagaagatccaggtgtggcaaatgctacagagggagttgtcacggtagatgatttgagtttacatgctaagtcaattggggcagtctctcttcctccgcataaggagattgaccaagctttacttgcacgtgatatatcacaagacatggcgccataccatttagaggatatccagaggcatctctacttggcaactatgtcaagggattttctccagctgcagatggatgagagtgcagacctgaatacagatgatacaccacagtcttctaatgaagtcatcaatctccaggtactactagaagagactgaaaaaagcaagctagctgtctgtgaagagcttcagcaatgtagacatgagctctcggacatgaatactgtgaaggaagaacttgaactaactgtagcttctctgacagacagaatcaatactagcaacaataaatgcgaacatctggagtttgagttacagtcctccaaggagaacacacaacaaattctgaatgagttagctggttgcagagcaatgctggaagctctacagaaggagaacctggagctaactgcgactcttacttttgagaaagaagctagaaaggaagttgaggagcagcgggagcatctgtgtagtgaaaacaaaagggttttgtcaaatctgtctgaccttgaacttagtttagcttctttgaaagaggaaatgaatgatggcagtaatagatgtgcagatttagagtgtgaactgcgttccaccaaggagaacatggaacgtactttggttgaattagcaagttgcaggaattcgttggaaacactgcaaaatgataatttggagttatctgcaaattcttcctttgaaaaagaagcaatcaagaaacttgaggaggacaatttatgtctatctaatgaaaagcagggccttttattagatttgtctgaaacaaaggaggagctgcatctttcatatgccaaacatgagcatcttgagtcgcacgccagagatatggaaacatactttggacaacttacggagcaattaattgaagaaaatatttacacaagtaccagcgtcgatatttatcaaactataaccaaagagttgtatgctaagtgcaatgttgtgctgggtgaagcccggaatgcacatcaagacaatgaggcctgtctggactcatcagaaatcattgttgaaaatgtggaaagagaaaccacaagtcctgaattaattggacatgatgataatcagcgtccgcttctagtcgctgagaatgactcatgtaactctactgctttacagtcactgaaaggccatctgaaggtcgctaaaggtgatttgcgtgaccttcaaaagttagtagagaggatttcttctcggtctgatggacgtgtgctggtatcaaagctcattcagtcctttgagtcaaaaggaaatcaggaagatcttgggatgtctgagggagagcatgacaatttaagaaaattaactcaggagatgatatgccgccttgtggagaagttgaaggctatgacgtcagacattgcaaagacagaagaatatgtggctgagctgtgcaacagaatagaactttctgtgaagtttatgtcacagcatgaagcagaaatagagcatactgcagttcttgtggccaaaatggatgggtttgctggtaagctgagcaactacaaggacacaattgatcaactggttagtcaagttgctaatgtacaccaggatgcagataatcatgctggaaggctcattgatcaagcagaacttttgcagaatgatgtgactgaaaggatttccactcttgagaaggaaaggacgtccttgacagatgtgctcatggaagtaaccgataagctcagcgctttgagtaaaaatgcacttcctagtgatttgggtgggagtgaaggtcttggctctcttgctttgagttctgtggaatgcgctgctaagttagttcaaaatcttcaggagaaactagagcatgctcaaactgacaatgctaagcttaatgcttctctggtggagctcaaaactgcacactctgatgttcaagaaaggagtaaacatgcacatggaattgtcaagaaaatgtacatttccctgcaggaacttctattcaactcattgggaaatccagatgaatcaggtgtcgaatacaatgctgaagaaccaatagaagctctttttagtcaatatggagacattgttgagcatttgaagagtttattgcacgagcggcaatatttgctatcaaagaatactgacctagagtcaagattgttgagcaaatgtgaagaaactgaagctctcagcagttctctgacaaaaagtatgaacgattttagcttgctgaacgaggagcttaaatcggtttctacaagtagaattgaagcgcaggatgaactgcatggtagatgcctcgctatagcagaaaaaatggttcatcgttccacaagccattcatcaacagtactttcttcgatggaaatgtccagcaaggcaaaccatattcttactacattattgccatgtattgaggagggtgtggcttcatacattgaagaatttgaaaatatggcagaagaaatccgcttatcaaagatctgtttgcaagaaagcaatattattggccaaagttcatctgaaaagtggtcagtgtccttgcctgtgttgatcaaagaggaaattgtacccatattttttgacctgcagggtagaattgatcagctcagcacgttaaacattcagctagaaactgaagttccagtcctgagggatggcttgacaaagctggatagtgctctcgaaacttcacgtgctgaacttcagaagaaggtttttgaacttgaacaatcagagcagaaactttcttctgtcaaggaaaagcttagcatcgctgttgcaaaaggtaagggattgatagttcagcgggacagccttaagcagaccctgttggaaaagtctggggagcttgagaagcttgcacatgaactgcagtcaaaggattcattgctgatagagttggaagccaagatcaagtcctatgcggatgcagatcgaattgaagctttggagtcagagctctcttacatacggaattcagccactgctttaagggactcattcctccaaaaggattctgttcttcagagaattgaagaagtgttagaagatctagatttgccagagaattttcattttagagatatagtagaaaaaatagaacttctgtcaaagatggctgttggtgcttcttttactgtacctgatggtaataaacaatcatctgtggatgggaattctgagtctggtgcggccattgatagtataaatgatgaacaaaactcaaattcaaattcaggggcagaagaaataaaaataaaatacgatgagctacataggagattctatgaacttgctgagcacaataacatgttggaacaatctctagtggagaggaacaatcttatacagaaatgggaagaagtccttggtcagattagcatcccccagcagttcaggatgcttgaaccggaagatagaatagcttggttgggaaacaggctactggaggttgagcatgaaagagatgcattacatttgaagattgagcaccttgaggattcctctgagatgttaatttctgacctagaagaatcacacaaaaggatttctgaactaagtgcagagatagttgctgtaaaggctgagaaggaattcttctcacaaagcctggagaaactgagatttgacttccttggactctctgagaaagctgttcaggatgagtttgtcagagataatttgcggaaagatctagctgaactgcaggagaagttagctgagaagactgaggagagcaagctttaccatgatatggaaatggagataaaaaaacttatggatttagtacgagatgcattgcaggatgacagtaatactgaaatcccatcgggtgctggtgttggtgctgctgtgttgtgcttgggtagtctgttgagtagacttatagatggctataagactcatttgtcagaatcaactgttcgcagttctgcggagatggaaacactctcggaaaccaaaatatctaaagatgcctctacatcagagaggggtatggaggaaaaagagatggcattgaatactttgagtggtgagttagaacacactcgcaatagtctggccttggttgagcaacaacgtgatgaagctgtggagaagacacaattactaacaatcgaactggagactctacgtgctcaaatagaccagttgcagggagatggtgccgaacagatgaataggtaccaatctcttatgcttgaactagaatcaatgactaagcagcgtgatgatctgcaagagaaactgggtcaggaggagcaaaaatgcacctcattgagagagaaactaaatgttgctgtaagaaaagggaagggcctggtgcaacatagagatagcctgaagcaaactatggaagagatgaacactatgatagaaaaactaaaagttgaaaggaaacaacacatcgaatcacttgaatctgagagatcttcgttgatgggtcgattagctgagaatgagaagagcttgcatgatgcaacccaatatctgagtagattattaaattctctgagtacagtggatattggtagagaattcgatactgacccaatcaccaaggttgaaaatttttcgaaattttgccttgacctacaaaatgaagtgaagaaatcgaagcaagcaacagagctgcttctggctgagctaaatgaagttcatgaaagagctgacaacctgcaggatgaactggtcaaagcagaagctgcactgtcggaatcatttaagcagaacagtgttgtagagtctgctagagctgatgccgttcgccatcttgaacgtattatgcatatgcagtcacagacaaaaaggaaacagatagatcatttgatggagctgaactccaccagcagtcaactaagagagatcttctctgaacttttacatcatcttctcaacactttcagtaaggatgtggacattatcaactacatggagagctttgtgaaatcttctgataaatggatggacagcacgagtatggtggagatacccatcacatctaatcatcatttgtcaaatagcataagcagcaaggtaatttcaatgagtttttttttaaaaaaattgacatatatataaactcacaacacttcctatggtttagaaaatattatgctgttcagaaatgtcggaaatgatatcgatcaaaataagtccctttttcttgcatttactgctaactctcgtgagtttttcataattagataactgaaatgtgtttttttttaaagatgagactcacacttctttatcactctaactgtactcgattcaccatgaaaaaaatcaatatgttgctgtcaaaaaaagggaaatcaatgtgttttcttggagttgattttcaatacaattagaaacccagatgaccattatctttttattgctgctttatatgtaattatttgtggtacatgaaattctggtagtatttgacaactcataattcatcgtactacatgatattttggtagagttattcttttgggtttgcaaatattgctttctgatgtgtcagacttgctcctcgcagatggctcatattccaaatgttccactgaaaattacgttggacaatgccgatgaaacccagattttgcatcatcttgctactgcatgccatgctgtagctgattgtgtaaatgactgcaatgatctcaaaagtaggattcacgagcatggtttttcagttgaccggaaagctgccgatctgttcaatgttatgtccaacttgcagaacaaatttacttctcaaaatactgagttggaatctttgagagagaatattattgaattacagtcagagatcaaacagagagatgaggaaattttgtcaatgcgcagaaatttgagtttgctttatgaagcatgcactagttcagtttctgagattgaagggatgactggtattgagtctggtgaccatagttgttctgttgtgcagaaccatttatctgcagatgaccatataaaatcagtagttaatcaattagttgcggccataaagactactcagaacagtaacgaaggcaacacaaaggaactaaaggccactgttcttgaattgcagcaggagcttcaagaaaaacatatccaaataagtacaatcagtgcagaacttgcatctcaggtaaaggaagctgaatcttctgcgaagcagctatctgttgagcttgaaaatgctagaatggaaatccacaacttagagaaacactctgaaatgttgcttaatcagaagaagaatttagagactcaagtaagcgagcttaaagatatggaggcagtggcacatgatcagcatggaagaataaaggacttgagtgatgaacttagcaaaaaagaccaaggtgagccaatgcagttttctttaattgggtttgcttcagttagttgtgttttgtttgtaataacatgatattgttttcatgaactatcctttttcatttatgcttttattgatattttttttatgtattgtgcagagattgaaggtttgatgcaagcacttgatgaagaagaaagggagcttgaggtcttggagaacaaaagcaatgacttagagaaaatgcttcaagaaaaagaattcgctttaaagagtcttgaagtttctaggaccaaagccttgacaaaacttgcaacaactgttgacaagtttgatgagttgcatagcttgtctgaaagccttcttgctgaagtggaaaacctacagtcacaactgcaagagagagattcagagatctcttttctgcggcaagaaatcacgagaagtaccaatgaactgctaacaactgaagagagcaacaagaagtactcatctcagataaatgattttactaaatggttggaaactgcactattgcagtttagtgtacactgtgatagcacgaatgattatgaatgcactcaagttcctgtatatatggatatgttggagaagaaaataggatctctgatatctgaatcagatgaattaagggtgaccctgcaaagtaaagattctttattacaggctgagagaaccagaatggaagaattgctgcgtaaatcagaggctcttgaatcttctttgagccaaaaagattctcagatagggttgcttcgtcgagacaggacatcaggccaacctagcagatttataaacttgccaggcacttcagagattgagcaagtggtgagtgagctttttttatgtgtcgtttatctgcacaaagtgtatgaaacaaattaatattaaccctgctgacttgtatgctttgattccaacgcagaatgaaaaagtaagcccagctgcggttgtcactcagattcgaggggcacgaaaagtcaataccgaccaagttgctattgatgtagaggtgaaggacaagccattagatgatgaagatgatgataaaggtaaatttagtccctggtatacttaattcaaattgaagtgtccgcttcattctccgattgacctcctgtttgttatttcagcacatggtttcaagtcactgacgatgtcacacattgttccaaagttcactcgacctatatcagataggattgatggaatgtggtgagtacaatttcagttcttaccgaatactgattaaaggtgttttctcagggttcccccttcttttttcttaacagggtctcaggagatagattgctcatgagacaaccaacattgagacttggcgttttgctatattggattgtgctgcatgcattgcttgctagttttatttgaagattatatgtaaaggtaagtgatgctttttgtctgtcattaaaatttgagcgatatagctctgcagctatttacctgtggtgatctgtacaatgtgctcggtgaatcatattttattgcatctatgcttgagtttgaactttgcacttaactttcacttaatgccacctggctacctgcaggccctgctgttcagaagagatataattaagcagtgtgtaccttttatagttctttacactaaatcgaaagaaattcacaatctatttctttaactctacctcgtgatctaacccaaacactcatgatatgcactttccagtcaagatcttgtacaagtttgttcaatacaggcattggtgaagataaataattttaggtttgacatataagagttaaatatgagcaagattaaatggtaagctttctttaataaatgctctggaccaccgttaatatttggtctgaatatcgatgagttagcatcaaacttctactgatttgttgtatgctgtctccacaatccacatagctcatgacacatccctttttggtgtaactacatgatatttgcatgatgaagtcgtgtttgcgtctcagcaatatactaattaaattctttgaatggtatttttgcagctgtagtgatctcctttggtgagctactgtacagtagtatgtctatactccatagcaagctacacaaagaaagtagtccgcgctaatgttgttgattcttttggatacgttacaaggatactcgtattggcagctgcgaatcaacttcaggttgtcttcgagatgcatttgtcctgcctcagctggaatagagaactgaagaaagcagcagcagcagcggcaaagatcccctctgtaaatactctcatttttgtttgctctattctttgcttttagaaagatgtagggcataattttgaatggtagtagaatctacattatacgtaacagctttacagaagaatgacaagtagttctcaaagttttagggtattgggatggtaacagcttttcccccactttgaaagttggctccctgtattctctctctctacccaatatttttgtttacatgtgcaacacagcaattatttcattattattattaccacactgacctgccatggggagctttcatgtttttttctccctctctgaaactgcgttgagaacattattaccacaatgtgatgtggcctgtggggagctttggcattttcagtttttcttctgtgaaagtgaaactgcaagaagaattattatgtcggagtatatcgatccgaaggccagatttgttcggtttgaaggaattttaattcataatataaatggaaaaagtgaagaaatatgaataggaaagtaaatattcgtttgatttgtacatattaatcgtgcagctcagccaacattgatatgttgtttagtccatgtagtcccaaaatatcccaaaatgagatgttatattttagaattaaagcgagtagaacacttcacatttgatccataataaactattacggcgtaatgggcgacgtagaacggaggctgcattcccgttccggcccatgaagtcactgactttgaggccccgttacgcctaatgttggccgtgggggcccactagtcagcgtgttaggccgcgggtagggttcgcccactagcggagacactccgtacgagataggcacgcgcgctcatggagccactcgtgcgatcccccgtcacatcgccgccggcgatcgccggagcagcgtcgccatccccgtcccgctccctctcccgcagaagagcccctccggacgccgcggccttccctaagccctgggtgatcccttcctccagcgtcaaatccgccgcgtgcttgcagctgcagcaggcgcgcgctccccgccgatgcgcgcggctcctcgccagcgccgccgaaggaggacgaagaggggaggagggctctccggcctcctccagtgatgcggatgaccaggcggaagccttgcccttcctcgaggtaggcacactctctctgactcgagatatttttggatgaatgaaatcaatggatagctggctatgtattggctgggtttggtgacattttagttaatttaatcagctgggaaactggatgtttctattttattttaattaacaggagagtaactgatagtttgatacagattttgcttgttataaggaagaacttagaaaattgcaaggctaagaaggaagattgattagttatttaatgtctgtgaggtattcaagattccacgatagatgattgttttcctcctttttataatatattgcaagagtgatagccatcatacgcaaacaagtaaacatggtgagagtggtgggagcaactctggtggatctagagccggcctattcagaacaccaatttcagggggcgtacacactgcgacttctgttcatgatttacccccaccggctcgagctgttcgcaatctgatggagcaggtatctgatccaaatactgtggactcttaaatacgatctatcagtagctagtaatcgtgattcatgcaaaatgtttgggaacttgggtttatcataccgagccaaaaaaaaaaaaacttgatagattcaccacttgtacaaaaccaggcacggtttgctcatctgtgtactgtcatgtctcggatgcatcatcgacgtgcaggatacccgtttggttctctagtggattttgcacctgatccaatgggacgtaagttctcaatcatccttttttgttgtatacaactttttggataccgccccttatgaggattgttttcccccaatttctttatgcagaccccattttttcactgtcccctttagccatccacacaaggaatcttctggaagatccgaggtgcacagtcgttgtacaggtaattttgatgtatttcataatcatatccaggttattttttttgctaaagcttctcatctttctttcttcaggtgcctggatggagtggactgtcaaatgcacgtgtaacaatttttggtgatgttgttcccttgcctgctgacctgcaggtttgtaccaaaactgctacctgctcattaattccttatgatgccttgatatcattgttggctacgttactctatttggggtgtgtttagttcacgccaaaattggaagtttagttgaaattggaacgatgtgatggaaaagttggaagtttatgtgagtaggaaatttttgatgtgatggaaaagttggaagtttgaagaaaaaatttagaactaaacaaggccttggtaaattgacttgtactgaagtctgaagtatggcttttttttcactattccagtttacctcattacctggtatctacctttcttgactctccaaattgagctggaccactgggtagctcttacgttttatcctagctgacatgtactctctggaaccgtttcactgaccaccattccaattaaaaaagttaaaaagaccaaaaaaaaaaaacacccagacatgagctatgggttgtacctgaggtttttaatctccaagaatgtgagttatatgatacaaataactaacatggccaacagagtctgaaatggaagacaagcaaaaactatttacatgtgattatctctgccattatttttcttttcttcaggtcttggttgattttgtcaacggaaatagtgacttgaaagttattttttttcaggaatgggctcatcaacagtatgttttgaagcaccaacagtgggcatcccatcagtggggcaacttttactattacaaaatgcagacaataaggtagtttttggagttgctacatggataactacttctctcaatatttaattgtggctctttatttagcatgtgggatttcacaaagtttagtagcttacaattgtttgtggtatctattgattgacacaccctttcataacatgctatcgatcttcttctgtggttttcataatgtttgtgaattgtgaacattccagtgacatatatttcattggaggttttggcactgttgcttggttagatgtgaaagaatacgaggctctcaaacctgataagattgcgactgatggtggggagcaaagtttaaaggtaaggctatgattctttgctcaagaataacctggggagtttttttctctttttttggggaaacatgtatggtttgcgtattcagcctttagactatttgaaagtcttcgatttctcttgggctctttgcagaagtaattcattgcatcgtttattcttttcatcaggaacttaatgcaatgtactcaaagcctttgaaagagcttttatcaaccgaaatagaggtagatgatgcagctcttatatcaattgatagcaaaggtattgatatacgagttcgacaaggtgcacaggtaaaatatttgggaacactacttactattagtttctggataggctacttcattttattgttataatgatctgaactgcatagatctggtgcactttacatagattcgcactgtaatgtttgttttcataagcagtaggcggttcttatcgtgtctgttatactgtcattgatgccatatattcctcatgcttttgttgtgggattttgcagttcaacatccagaggatagcctttgagctgcattacagcgtagaaacacttgaagaagccaaggaagcgattaggaggatattaggcaaatcaagatggcatgccaaattttagacttccttcaaatctgaatgatgaattcatggatggaaactatcaagcgcctgaatcctgtaaaatatttgtatatactcatgtaatttttgactttgtggtgtgccagatggaataagggaattccatttcactcttgtgttacaagggcctaaaaggcctgaagactaaggatagagtcaaatgttattagcttctgtacagtcaattcacttctagtgctgggtttgataggaaacgaagtacatgcagctaacaaaatgtaatatccaaaaatggtttgacaattgagattatgcaagtctattttatagatgttgctcaggtttatgacatgtcgagttcaagacgcgttcgtgaaaaaaaaaacgttgagttcaagacagtgttttcgaactgttcaatttccttgaaacttgacaacagtttaaactttaaatggagctgtataaaaccaatgaaacctgatcgtcccccacagaacaaattgtaccggttgtcattgcaataattcattagttgccagtaatagagcagcaaacgaacaaagaagaaacaacttttggcactcaaacagttcattcgatgaataaaagaaaaaaacttagctcaatgcgttttagctttagatgagtaatgcaaaatttcgcaataattttttgtacatgtatctttttctaatcgagataaattccataaaaccataggtgtaaaaaaaaatctaaattatacaaaaccacatggtttcgcccgctggacctaaaattatgttgaaatatactactccctatgtcttattataatatgaaacggaggaagtagttattttaatttatcattaaaatgttgtagtcatgaatgctgaatctttttttttatttttctatagtattattaaatagactagttaacgtcgtggttttacgaaagttaaggaccataatagcgtattaccatggctatgtgcaaacatacctaaactaatacgattttatgtaactttaatcacaacatctaagttctatgaaatttactataagaagagtaagggtctgtttagttcgcgaaaaggaaatttttgggtgttacatcggacgtttgaccggatgtcggaaggggtttttgaacacgaatgaaaaaactaatttcataatttgtctggaaactgcgagatgaatcttttgagcctaattaatctgtcattagcacatgtgggttactgtagcacttatggctaatcatggactaattaggctaaaaaaaattcgtctcgtgattttctccctacctgcgcaattagtttttaaatttatctatatttaatactctatacatgtgtccaaagattcgatgtgatgtttttgagaaaaaaaatttgggaacaaaacagggcctaaattaaaaagaaccagataataatctaataaactcatacagttgcaaatgaagaaagtaaaaacaaaaaaaagaaaaaaaacatttcacactctatccatattgtagcgtgtcaaacactctgaactgacacgtgatgacttagctggaagcggcacggacggccacgattcgcccgcgaaaaaatcctcacgacgcgctccccgcggaaagaaaccgagcattttccgaaaaaaagaaaagaaaagaaaagaaaacaaaaaaaaaaaccgcccgcggctatacacccgagactcctacggatcgaagccctagggtttggtctcgcctccatccccatcgtccgatccgatcccccgccatgagcggccaccacgaagctaagccctaccagccccgccgcggcccggctcccgccgacgaggaggccgcccccgccgctgcggcggacgaggcggaggcggaggcggaggtggaggctatggagcggtacgagcaggagcaggagtacgaggagggggaggagggggaggaggaggagtacgagggcggggagggggtccccatggacgccgacgcctccgccgcggccgtggcggggatggacccgcacggggagatggtgcccgtggccggcggggaggcgggcggcggctacccgcacgtggcgtcgaacaccctcacgctgtcgttccagggcgaggtctacgtcttcgagtccgtttccgccgagagggtgctgtgcctgcgccgctcatccatgatttcagtttttttttgtgtgtgttttgcgcacctgaattgctcggtgaatcggtgatgagtttgaattacttgtgttggcaggtgcaagctgtgctgttactgcttggaggaagagagctagcaccagggtcgggttcggtaccatcatcttcagcggcatacagtaaggtgaagtcatcgctgggcgaattatggtgattgccagttgagactattttaaattgtaatggtgcttatgtgactgtgtgtactctcttatgcagaagatgaattttcctcaccggatggcatcattgatgaggttccgggaaaagagaaaagagagaaactttgataagaagatccggtatactgttaggaaggaagttgcacttaggttagttagactagccttttaatatagccttcttttccctgtctatattctagagtatttgttatgttgtgtatttagtgttagcttattaatataatccattttctctgtttaatattatgaagttttcttatggtggatgaacttgttattgcatttgattttgtatatttggcaatgtgaattttcctttttaagttttatgagatagtagtaattattttctatacatttacaggatgcagcgtaatagaggccagtttacatcatcaaaatcgaaggctgaagaagcaacatccgtcataactagttcggaaggttcgccaaattggggcgcagttgaaggtcgacctccatcagctgctgagtatgtattcaaactattgtacttattatatctttatatgttcatacttcccattagtattatataaatgcatgaaaatcattacaaccatatttatatgagggatggccatttctttatgtagtaaataagtgtgccattcatggatcctgatttcccacctgggcaactgaattgtgttgtttcgaaaattcatccataattgggaaatatattcaatatgctccaattataagaaaatcagtttccattgcaacacatgggtgcactgctaggtatatctttgacctagtaaggatgcattatctcatgctcgcactgtccacagggacattgggctatcatacagagactttgtcgttttctctcagtcaccaacccaacctccaccatgtgccatgcagcatgcacgcacgtcgctggagctagctagctagccattttttaattgaacacttctgggtagtgagaactgtgaagccttgaatcaagcctttaactcagtttgatatttgaaaatttacagcacaactatcctgcatatatttcaattgtagttgggtgcaaaaaataaatcaaaatgcatgggaaacctccagcggaaaatggatcaatgtatacatctttctagttcctgataaaaaaaatgtagcatcaatttctgtaccaggcaaggtagaagcacgtgattctaaatcttgactattcaaggtgtttgccatgtggcgaatgtgacactgcactttcgtactgtagaaggtcatgcagcataaaattaaaaatttcgaaatgagaattgtctgacttgcatcattcactgcttaccagatctagctcttccatttcagacaggtttttgctatttggctgttgataactaaaaaatgatagttggtcttgatcaattgtttgccacccacatgataatagatgcctcttgcctcttgcacctgttgcttgtatatttgccttatattttctagcttcttttgcttcagaatttgaaacttagttcttgttgtgagagttactttccatgcacaattctttcaggtgccatcattgtggtattagtgcagcgtcaacacctatgatgcgccgtggtcctgatggcccaagaacattgtgcaatgcatgtggacttatgtgggcaaacaaggtacttccaatctttattgcactgcaccagtatctttctatacattggtgctaattgcaacttctagaataggctgtatgttgtttgcataacctttgttgcatcgagggtgtctccttcaatattaatataatgaacaatttttgcctttctagagcccaggtactgtaaaatttccccttttaccatatgctaagtttggtggtaaaagttatactgttctagcttgattgttgtagctctcagggtggatcttttgtgtgatctgttgagtgtccaatgcatcccaaatcacagttcacatgtatggtcccatcgtgaaagttggaacaccagtaaacagtcatggaaattgtaacgtccccacccaaaacctccattaccccagtggttcagtgttggttttaagttcttagcttgcagacaagttgcatttagcgtttttagggtcagtcttggtgttattgacaatattctgctccaatttgttcgtatttcgtagggtacgatgagagaggtaacaaaaggtccccctgtgcccttgcaaattgtgccagctgcaaccaatgatgttgtaagtcactatgtttgcacttcattcattcagaattttagattgcaaattttatttatagatttacccctcatccttttctaactcaaatttagcgttgtgtaaaaccattgtttgggcctgatgaaattggcattagagtgtaagacatatggactgatgaaatgcatccttagggtgcacttgttctttctttataggatgaggatttgtgacttgtgagcacgaaacaatcatgtattgcagtttctagaaaaaataactgttctagagcagtgaattttaaactgggtcagtagtcttactcaaaatgtgaattacccgtgtttttcagcagaacggaatcgtcgaggcaacaggtgtcgagcagcacaattctgcagtcgaggaggcagtttctgctgcaaatggccatgaatcgcagtcgggagtcgcgtgatgcttgagggttcagacttgagaaaaaggaggaggatgcgtatcaatcaacaatcaagtagtcatggtgctcaacaagttaaccggatgtatgatatgaccggctctaggattcatgtggttctgcaatgccggtctctccgagatgatatatgcttgtggccggctttttctatgcttgtatttgagttttatagctttgcctttggcagtagataaatggacgagttcagcttgagcgcatgtgacatattttgcattttactctcttgtcagatgtaatcgttgatttacaggtgacactgggcaagcaggcaggttaatttcacaatcgcagcatcagtgcattgtctgattttgtctcgtttctttctcctacttagggttcaacttttcgattgagccgacaaatttcgatccaaataacttttggttgaattttatcgttttaaatttaaattatcgagaaccatttgacacgaatctactctcgtcccgcgtcgaaccctcaaaatttcgtggttttccgtttttggattgttatttgtcgaaaacgtaaacactgctaagtgcaaacattgcaaccgatgctgggcttcgcagttagtttctctgcgcttgtagcgtgatgcgaaggccgttggatcaaggtttgacggcccagaacgtgacacgtgtggcgcagatttgcaaaagagccctcgcgatgatttgtattgcatcaggcctcctcttcctcttgtcttccatccccaccacgcgtgcgagacgagaccagcgcgacgacggccatggccgcggcggcgacggcggcgggggacgaggagttggagtcgctgctgcgaaacttccaccgcttctcccaggtccccacccattctctccggcgtgtcgcgagctcggcggttcgaactcgctctgtgtgtcctcccgccgtctcgtttttgggttttaggattagggttcatcgagcgaagtgctgatcacgaatgccggtagctgcttccagtttcgatgccatatcatgccaattccttcagctcaaatgcatttaacccaccagctcaagttcgggtaggagattagtaccgcgtgatctctgcttccagggctcgaatgctattccgtttcaaggaacatgatctaacaccctagcatttccaaattccgatgatacactttgatcttctatcgctgttctgttgtttcgaacaggggtacaaggatgcacttgtggaggcccaggctttaagggtgaactgcagctctgaatccgagaggcgtcaggctctcgagtcgcacgttgcagatctcaagagtggttagctgatatttgagagctgttttacaagcttaagcttcagtttgtgttgccttttatgttaatgtgaatactgtgtggtagctgatgatttgtgttgcttgttaaggttgaaacaatgagtgagttaataaatgttttgtgctgtgcagataatgagcgattgagaaggctgtatactgaaactttgttcaagttcaccaatcaggtctggtgctatttactctgtgcaatcgtaaggaggatggaactgtactgctacaataatgtgcagcaaacttagttgatctatttcagtattaactgagatgcacttgataatgcagtggcaaggggtgtgtggtttcaaccctaagatcccgtgtttaattcccaaaatgctcacaatttcttcttagaaaatgtttggagggacgtctctccctccaaatttcgttttttatttgagtgttaactggttggtatagatgaactcacctatcgacaccatttcacctgtgctgttgattgtctggtgctttcaatactacattaaatctcaaattgtgcaacttagtctagttttttatttttctacttggagtctggaaactggctgttagattgttaacaggacagctattgaaatggttatatgtagcacattcatgtctgtgaagcactggattagttctgaatttctgatgtgcttgatattcttcagatgaaatttcacacagagtctcgtaatctgaaggaagaactggaaaaggcaaacacgagattgctatccatggaagaggttaagaggaaaatatagtgtataattagtgtttccagtcaatccatagaacatatagtgtataattagtgttcatttcatgtaggagtataagagggaaatcgaacaacttaagcttggcagtgaaatgaacagcaatgacctggagaacaagctcaggtaaagtttcctttcaaggagggcagctaattgcataatttctatatgcaattaataaatctaacatctgctgtaaacagctgcgctgttgttcagcaagcaaccaatgaagctgtgataaagcaactcaatctggaactggaagctcataaagctcacattgacatgctaaatagcaggttggagcaggttactgctgatgtgcaccagcagtgtaatgctctaaatcctttccatgtgaaagattaaattcctttggaatacgctctctagctcttatgatgcacatatttcctggctcctactatagataaaaacgagatccaggatctgaaggatgtagtcattgttgaacaggaggagaaaaatgacatgcataggaagcttcagaatactgaaaatgaatgtaagttcaacctgtactgttctgttgaaacacacaaatcttgttctcccaaaccacccatatttcctgtgtcaattgaaacagaagaatgaaacataatgcttcaccgtgaagaacatggatttgaagaacagaactggagctaacaaatttcagttattcgacgacacgtttttgctcctttcccctagttggttaacccttaacaggattgttttgtcatggtgcagtgaggatcatgaagatgaagcaggcagagcagcaaagggattccatctcggtccagcacgtggagacactgaagcagaaggtgatgaagttccggaaggagaacgagtccctaaagcggaggctggcgatctctgaacttgactgctcatgagagaatgaaccaattcccctcttcctttgatgctctcacgcactgtacgtaccaccaaaccatcagaggctagaaaattagatcatttggctggctgcaagtcccacatgttcactgggttgatctaggactgcacattcttcagttaaaatgaatgcaaccaattcagtcacttattgcagctttgtcctctaccaagattcaagaatcaaggcagttcatccctgcctgacatctgatatcgcaaatcttctcgtgccagcctcctttttactcagagccattcacatttcatttattttcttttgcaatttgctgagctatgctgcacttgatcagttcagtggcccgcagcttcagaggtctgcagctccaggatgcaacctgtgtattaatcacagtgcaatttttatactgacaaaatcgagggccgggctgtgttctttcctcatggatgggaacactaccctccaacatggaaaatagagtagttcattagcacgtggttaattaatctatgtggacaactatcctccaacatggaaaatggagtgccgggctttaggttttattttgtccacatagatcctctgagtatttgttttggtctaaaatcatccttgggcccacttaatatgccatatggctatttctagtcaacaattctgttaaaaaaattgtcccttttgcccttaatttatatataactatacactagaaaaaagaaaaccaaaatgaataaataacattgtatatgtacttcccattatttcaacatgcgcagatgaaacttgagcctaatagctatcgtatacacttgcaagtacataatttatttttgttttacatgaattgctatgcattatctataaaaagaattcattgcatgcaattttttctcttatatatgtgatgaatggagaggggggaggggagggggtataagtgttatttatcaagagatttgttagttatgtgggttcaaggataagtttaaatgaaaataaaaactcgaaggactaatatggacagattgaaatattaaggattaaactgatccttgcatgaaacttggaggaccacttaggttattcacctttttttttgtgttataaattgttggaagcattagtagataggattagtttgaaacctctctataattaatttggtggtgtttttgttagaggaaacttctaggttttgtttttttaatggaacttccatgttccgtcagggtagagagatggtgagaacatgttttgcacccaagataagaaaagctcggcgagcgagtatgaaccctgtcgttcctgtcggccgctgccgctgccgcccgtcgaggccttcggtgccgccggcgggccctcctggcgctccctctccctctctctctagggatattttgggcacaaaaacctccaaagtggcatttcattcagtaggcaacatattaagtggcattttatccgaacccaacctagcgagtggcatatcatctgttttctcgttaggtaaaaagacagtaaggtaagaaaggaggttcagtttttcaaaggatggttgtttgtacatgcttgcggattcctattcagaatataagagtgacaaatcggagttaagttagttaccttatcaaaatttttggtagcattgatagtggtaatgaagtgaacagcctctcgtttcttgatcgtatcccttctttctataaagttaagatccaaagctgcctccttaattcgccatgtcatcaacattatatcagccgttggattctctgtaggtctccagatcaatggttcagcaataatgggccatcccatcccactcatgcgcctcttataaatccttctttctgttggcccaagcccatagccttgccaatcgtcacccatttaatctccctcatgactcccttggtaaggtgaaccatgggccagccggtattaatccagcagtgagttcttcactgtttccttcatccgcacaccgcagcaaccgcattgcctcctcccacccacggcgctgcacgtcgcaccggggcctacgacgcccatctctccccctcccacgctgagccgagcgcgccttgcagcctgtttgcctcctcggcgtgtcaggaggaacggaaccgtcgatgcccataaagagcagacttcatggctgtcaaaacttccacaacattcaaaccgcctcccagcttttaactgtcgaccaccgcatggactcctggagctggacggaagccaatcatctggttcgcctcctttgctcaaaactgtttcccccagtcttccaagaagcaaatcaagagctttaactcagccgcctacgtattgggtcgactctggttgcttggatggaggtggataccatgagcgtttgtgttctttgcttcctcgcttgagcacgatcagtggcgctcaggttgtttgctccccaaacagctgaaccgggttaatctattctgaggtaaattccccgaacaatgttttcccctatttgataaaatgcttatttacacgcaccatatatttcaactagacaggtagcaccagaatcacgattcacttttgagtttccgtctttctgatcttgagcaaacaacctttgaaatgtgcaacgatggagccgcagaaccacattaaggtgtttgtatctctctatcagtttgtggacagctttatctccctacatcagtattggtgcagcaccagctattaataatctccccctctttctttcccaggaatacatatattaaccaagagatatattgttaagaaatgataaatcactgaagcttttttaggataatttcttggcaacacaaaacccctcagaattacaatatttactgtatatccaactacattgtttagtactataacaaatagtctaatatatatcagtgaagtaacagatctagctgtttttttttaagaatgaaaaatctgaaatatttatatcactaatacatgtgattgccattcactgagctcgcggacgtcgtcctcgcggtgcaggacgtgctcgccgcagagataccggctgaaggccaccgcctcctcctcgtggtgtcgtcgctgtgcaggacatgcttgccgcagaggtaccggccggaggtcgctacctctttctcctggtggatcagacgtattgccggtggatgtggatggtgatgtttggtgccggactgctggtggatgtgaacaatgaaaacgacataaacgaacgtgaaacaatgacaagagaaaagaggaacgatggagaatgaatggatatacagagaagatgaagagttgaatcatcaagattatagaagaccaagagtcgtgacccttccggaaacatcaggtggctttacactttttcattttactccaacgtaagattgttttttatattttagtccttctcaagtgtgggagcacacgcacgaatcacgctgtgccacgtggcatcctaatcgctcgataatttgcacggatttcgatggtaagggattgattcggcgttaattgaaaaaaaggttagatgaggtgtcgaaaaaggggcttttttcgtgcgataattcctcttaataaagccggcgctatgtattcattagaaacccctttccatatacatcatatgcttggtatccttacagagtaaaaaattaacttggtatgacaagaaaattttgactgaacatatacatcctcacaatctataagaataagttaaatttttattggcgcttgctccggacattgacagtggcgcgtcatggaggtggccgctgctgctcctccatatccatcggagtctaggctcgccgccgcggaggtcgcgccgtgtgcgtggggcagagtggtggccggatccgccgccgcctcgcctcccgcccgcagtcgctcgtcacagtcgtgtccgccattacccgtgcaagaaccacgctggatccgccgtcatgccgcccgcatccacatcggacacaccccagcgcagctggatccgcgcacgtggggtgcggagcggcggccggatccgccatctcctcgcctcccacccgtctatcccttgttcagtttttgcacagcatcacatatatgggataaagatggtgatcaaactaaacattaacgtgcgtgcattctagatgagagtgaaaatgatcctacttagaaaggtggtacaacagaattcagatggtatgtaaagtaagtagtaatgcgcaagtagaataaagaatccaagcttgccacaatcttacaagcataatatagctctctcaagaagaaagaatcaaaactacggcagactgataataactattaacaagtaatcatttcagaactgaatacatacatctgtgctcactttcttgaccaatacatatacaggtggatagtgcagaactcagcccactggagacactgttggtgcatagttgcaaacacgatcaagctgagagttgtctccctgctgcattcggttgaacaggtagcctgcaataaacaaaggcaaaatttgcgactggacactaaaaacatgtaattagctaatagacatcgtaagaacgcgaatttgctgttggacacaaaaaaaactggtaattagctaccagacactcgttgctttattttattatttccgaaggaattggagaaaaaaaatactcattaaagacaattttacccttggtcaacaatgtaaatgctacaaactttgaacgtcagtggattagatttgacacaaacattagggacactttggccactcgaaatatttactatacttcaattagccagattaatcacttcctctctactccagatgttaatcccctttatgttcgattaagcaataatgctgtgctttccaagttacactccatccatctcctctctacatgtacaaactatctgaagtcaccactctcacctgttcgacgtcgtacgacctcgtcgtcctcgtcgtacgcgctagctatggccacgcgcgagccaccgcgtcacgggccacggcgccacccggctgtcgtgtccaactccggcgaccaccaccaccaccaccaccagcaacctttgcagcttcctcaatagagtcgtctccgcttggctcgtctgcgccgtgctcaccttgtttctcttcaacctcctctggttttaccctgtcgacgcgctgtggaacgccgcgctccggtccgtcgtcacttccggcaaattaggtaagcatccatcaatggcaggaggaggggaggaggctagatgtgactactgggaagggcggtgggtggcgcccatcgtcctggcgttcctcctcctcgctgtccgcctcgcgctgcccaagaatgcagccaaggaggtggcctactcggacctcttgactggcctccgcgcgggcgacgtcaccgccgtcgcgttcgaggaggactcccgccgcatctacttccacagggccacggacgatgtggggggggggggggggcggcgaggacaccgacgccggcacgggcgagtcccgcagaagcgcctcggcggcgaggtggctgtgctacacaaggagggtgccgcacgacgaggggttcttgttagggctgatgcgggacggcggggtggactatcggtcggcgccacggctggcggggaggctactggtgtacatgctgagcacgctgctcgcgctgtgggtggactggtggagcggcggcggcgggcgagtgctgcgatcgccgatgacgggcgaagcggcgggtgaggctgagaaagagagaaaaggataaggaagaagaaagaaaatgaaaaaaaaaatcaaagggtagaaccgtacttacacagctatttctctctctaatttttccaaatataataaaataatctcgcgggtgtccagcaatcaattatcagttttttacggtgccctacaatataaacacatattttacagtgtcttctaactaattacacgttttttggatgtcctatagcaaattttgccgataaagaaggcaagcaaccaaacgaacaagctttctggtcgctaccatgccatgatcacgcgtggatatagataatcacagattgcacataattcttgcaagaaataaaaaaaatgctcgtgcaggatccatgcgggagaaagggggcgctgtatccgtggacgcgccggatccgtgcgcattttgtagacgatttctatgatgtgaatccataatatatataccagattaagtctacgtcgagttaaaaaataacgcaatgtgtaaacaccgttggatcacaagatcgagtatgcaccagatcaagtgcacgtgaggcaggttgggttgtgggtcgctgagttaaaatttaacttgcacgtgaggctgggtggttgagttaacacttaattgtgtagcttgcaccagattgagatcgcgtgagggtgggcggggtggtgggtcgctgagttaaaagttaattacgtgggggtggaacagggtggaggttgtgtgtgttgggcgccatctaataagtagcgccaaatagtagttcaatatatacatattgatgttaatgaatatatatatatatatatatatatatatatatatatatatatatatatatatatatatatatatatatatatatatatggattcattaacataaatgtaaatgtgaaaaatactaaaatgatttacattgtgaaacggaagaagtagtactgaactactgataaagcatgccaattactgggaggcggtcgcccgtggtggccgtcgatggacggaagaaggattgagaaaggagaggctatgtttgatatgttgtgacaagtacgcggacagagagctagcccgcgtcttcctgccgcccgcgcctccccgttgaggcctgcgcacggccggtgcacgcccgtgccgtggagctccacgagtcagaatcctctgtagtcaactgcaccgtgccattatcactggcatgtgcacatgatcccaatccgagctccacacgggctgccgcagtgcttcgccactgcaaccgtcgcggcgccgtcctcctcctctccgcctcgccctgtcgacgtttgcaccgtggagctccggtgggctgccactgtgcttctccaccatggccgtcgtggcaccgtcctcctcatcctctcccgcctagccccgtcgacgcctgtgcaagctcgcatctcccagtcgacgcccgcgcacggccagtgcacacccgccgaccagcctgggcagagagagagagaggaggaaccgagaaagagaagagaagggagatagatgagtcagcctgacatgtggggcacatgtgggtcccacattaaatcagctgccacgtcggacaaaaccggtgtcaaaatcaccgaagaatttattgtgaccggttttaattagttaagagatgccggatatctggttttgcggttgggggacgattttttaactcgatgacaagttgagggaccttcggtgtactttttcctctggaattagtcacatatactaaaagcccatgaatgatttcggcccagggccaatccgtacgaattaggctgccaactggcaaggcaagatgctggcaagtggcaattggcttctctctcctctgcctctgcttcttccccgcctctcttgcttttttctctttcgtcgtcttgctcgcgctctcccttctcttccaagcccccccctctctctctctctcgtgctcgtcgcctcaaccacccccaaaatccccaaaaccctaggcggggctcgcggccgcgcctcctccattccaatggcggacatgctccgcttccccgtcgaccccgacctccgctctcctcctcctcctccgccgcctcctcctccacctccgcgggacgacggccatcgcacgcgggtggacctgccgctctttcatccaccgcccccgccgtcaccaactccaggactcaagcgagatcgctcaccagagggcgagctgctccctctcccacccccgctcggctcctcacgccccgaccgcctcagcgatcacctggagggggccgccgcgcctccgcgtgctgagatgaggagcgccagccccactcctacgtccgagaggtcgccttcaccgccgctgcgcttggacgacccggtcggctgccgcagtccaccgcgcggagagaggtgaggcgcgagagcgagacgtttcggttcaccttttgcttgtctcgggggttttgggttcttctgtgctcatgctttcaaactattgtgtgtcctgtgcgtgcgtgcacgcgcgcgcatttgggatttggtgtggtgcaggttcgcgaccatcggcttggagaaggagcgagccagggaaatggacagggacacttcatgttacgctcaatgtgagatgcatttgatgaacacttctattttgagcacaagcatttcgaagcaaaatcgtgcactgcgacatgtgtttgcatactatttgtcaaaccagagtttcggttgttaatttgggaattggggatggattgcttagacccatggaaacccatcggttttaggtgcttgtcctgattgctcaaaacctcttgtgtcaaaatcgccctgaaggttttgggcacttgaccctgcgtagttcagtataatttgtgtgtaattcgtcgattattaccgtgttacctttttcaagcacgatgatcgcgtattaaacagttaggtgtcttgtactcttctatgatttcataatactcaggtgggctataaacttaatgcgatcactatgaattgcacacggcatctttgtattagtgaagtttaaaagaactaagccatcagtcaacattggcacactagtagggtgactatgttgttagttggtacctatgaactttgattggtagcagagtagacttcagtacttgtcaatttacttgagaacaagaaagatagcgaattggtgtcaagtgtttacattattcctgtttcttgctggcgtacctttagtcaattgaaattcttggtatgaagggattgacgttgatctattattcattactatgtctgcagcttcaaataaaagttaactttaatgttcaaactcatactctatttttttctcattagcaaaatttattagatgcgtgcattaagacatgggccagagatataaaccatttccattatctcaaaagacaattcatggcccttcatgtgagcatgtctcataagaaaatgattcgtttttaggagatttgacacttattgcttttcttttagattgcttcaactatggatacgatggcctctgtaatggtcaaggtaacgcccagaggttggtagttttttttttctgtttggtatgttgctgttgctattactttcaaggttgcaaacgcagtgttgcattttgttgaacttttacttactaattccgacatctcaaaaggtgatgcttctgctgttgtttcattttgatacagtgatccaaacgccaaaggtggaatgacagttgaggagcaacctgtaccagtaagaaactatggactgtttaccttgttacttttcattgatatgcctatcagtattttcttgtttgtatggaggaagcgagaaacacttgtatttttcttaataatctttgaaactgaactaatttatcacgagtctttctttgttttagtaggtttacattgcactggactattaattccttcctcatttttccctattaagttacttattgccatgtttagctgtttgtgcctatcgtaaaaacgagctgtttctttgggattagtatgaaatgctttcccatgtccatgtttgtctgacagataaatagaaatttgatccataatttgttgtattcacttgtcagttgtcatgagtgaagctgttttgtagatctttcaccttttctaattccacattagtgtagtagaatgcaatcttattaccaacaactgattttatccccctgaaaagatataacgtactagtaatccacaacaagattttactcttgtaatatatttgtatgccaagtcttgttgagttgtgatccaaattcatttgcacttaataaaggccagcttctgccatagcggagcgaaggcccgtcgccgggaggcttgggccggagcgtcatcccttttaggattccaccatatatatacttcttgtaacccgtcgtgcggcgatgtaacctcaccccagatatagtgaagatattttgctggctggcgcccgcagtttttctctcctgttttgggagggttttccacgttaaatctcgtgtcttctgtgattgatctattgttctttatcgtttgttcgcttatcgtttcctaacaagtggtatcagagcttgttcccacattagggtttcgcgatggcgtcgatgaagtatgatctaccgctgctagactacaagacgagattctcgctgtggcaagtcaagatgcgggctgttctggcacaaacttcggatcttgatgaggcgctagaaagctttgggaagaagaaatcgactgtatggaccgctgaggagaagcggaaagatcataaggctctgtcgctgatccaacttcatctatctaatgatattttgcaagaagtgttgcaggaaaagactgctgcagaactttggctcaaactggaatcgatctgcatgtctaaagatctaaccagtaagatgcatatcaagatgaagttgttctcacacaagttgcaggagagtggttctgtattgaaccacatatcggtcttcaaagagatcgttgccgacctagtgtcgatggaggtacagtttgatgatgaagatttaggtcttttactgttatgctcactgcctagttcatatgcaaattttcgtgacaccatacttttaagccgtgatgaactaaccctagcggaagtctatgaggcgctccaaaacagggagaagatgaaatgtatggttcagtctgatgcatcgtcctctaggggcgaagcattgcaggtcagaggcagatttgagcagagaacctataacgacagcaatgatcgtgacaagagctagagtagaggccgttataagtctagaggtaaaaagttctgtaagtattgcaaaaagaaaaatcacttcattgaagaatgttggaagctgcagaataaggagaaaaggaaatctgatggtaaggcctctattgttaccagtgctgataactctgattcaggagattgtcttgtcgtttttgctggttgtgttgctagtcatgatgaatggattcttgatactgcatgttcgtttcatatctgcatgaacatagattggtttagttcttacaagtctgtgcagaatggagattttgtgcgcatgggagatgataacgcacgtgagatcgtgggcattggctccgttcagatcaagacacatgatggcatgacacgcacgctgaaagatgtgagacacataccagggatggcgagaatctcatctctctcagcacacttgatgcagaaggatacaaatactccggttcaggtggagttgtaaaggtatcgaaaggttctctcgtttatatgattggtgatatgaattctgcaaacttatatgtccttagaggaagtacattacatggttctgttaccgctgctgctgtttctaaagatgaacctagtaagactaacctgtggcatatgcgtcttggacatatgagtgaatttggtatggcagaattgatgaagaggaacctgctggatggctacattcagggtaacatgaagttctgtgagcactgtgtttttggtaagctcaagagggtaaaattcaatacctcagttcatcgcaccaaaggtatacttgattatgtccatgctgatttgtgggggccttctcgtaagccctctcttggtggtgctcgttatatgcttaccattattgatgattactctagaaaagtgtggccttatttcctgaaacataaagatgatacatttgctgcttttaaagagtggaaagtcatgatagaaaggcaaactgaaaatgaggtaaaagtacttcgcactgacaatggtggtgaattttgttcggatgcttttgatgattactgcaggaaggaaggcatcgttaggcatcacaccatcccgtacactccacagcagaatggtgtggctgagcgcatgaacagaaccatcatctccaaggctcgttgtatgctgtccaacgctcgcatgaacaagcgtttttgggcagaggctgctaacaacgcctgctacttgatcaacaagtcaccttctatcccacttaataagaaaactcccattgaggtatggtctggtatgcctgctgattattcacagttgagagtttttggatgcactgcttatgctcatgttgataatggaaaattagagcctagagctattaagtgtatgtttcttggttatggttcaggagtaaaaggatataagttatggaatcctgaaactaataagacattcatgagcaggagtgttgttttcaatgaatctgttatgtttaatgatagcttgcccacaaatgtcataccaggtggttctgatgaggagcagcaatatgttagcgtgcaggtggagcacgtggatgatcagaaaactgaaattgttggtaatgatgttaatgatactgttcaacactcacctcctgttttgcagccacaagatgaacctattgcaaatcgcagaacaaagaggagttgtggagctccagtccgccttattgaggaatgtgatatggtttattatgcttttagttgtgctgaacaggtggagaatactcttgagccagccacatacactgaagctgttgtttctggagaccgtgagaagtgaatctcagctatgcaggaggagatgcagtctcttgagaagaatggcacatgggagctcgtgcacttgccaaaacagaagaagcctgttcgttgtaaatggatcttcaagagaaaggagggtttatctcctagcgagcctccaaggtttaaggcaaggttagtagcaaaaggttttagtcaaatcgctggtgttgattataatgatgtgttctctccagttgtaaagcatagttcaattcgcacattcttcagtattgttgctatgcatgatcttgagcttgagcagttagatgtgaagacaacatttttacatggagagcttgaggaggagatatacatggaccagccagaagggttcatagtacctggtaaggaggattatgtttgcgagttgaaaagatctttatatggtttgaaacagtctcctcgtcaatggtataaaaggtttgattcatttatgttgtcacatggctttaagaggtctgaatttgatagctgtgtgtatattaaatttgttaatggatcacctatatacttgctgttatatgttgatgatatgctgattgctgccaagagcaaggaacaaatcactacattgaagaaacagttgagtagtgagtttgatatgaaggatcttggtgctgctaagaaaattctaggtatggaaatcactagagacagaaattctggtttgttatttcttagtcagcaaagctacattaagaaggttcttcagcgttttaacatgcatgctgcaaagcctgttagtactcctattgcacctcattttaaattatcagctttacaatgtgctagtactgatgaggatgtagaatacatgtctagagttccatattctagtgctgttggttctttgatgtatgccatggtttgctcccatccagatttatctcatgctatgagtttggttagtagatacatggctaatcctggtaaagaacactggaaagctgttcagtggattttcaggtacctcagaggcacagctaatgcttgcttgaagtttggcaggactgataaggggcttgttagatatgtggattctgattttgctgcagatttggataagagaaggtcactcacaggttatgtatttaccattggtagttgtgctgtgagttggaaggcaacattgtagcctgttgttgcccagtctaccactgaagcagaatacatggctattgctgaagcatgtaaataatcagtttggttgaaaggattgtttgctgagctttgtggagttgattcttgcattaacttgttttgtgacagtcaaagtgctatatgcctcactaaagatcagatgtttcatgagaggacaaagcacattgatatcaagtaccattatgttcgcgatgtagtcacgcaaggtaagctgaaggtatgcaagataagtactcatgataatcctgctgatatgatgacaaagcctgttcctattgctaagtttgagctttgctcaagcttagttggtatagtggtttagtccaagaggctatttggcgccgaaagtgtttttgtctttttgtgttcagggtgaaggattgtttcatgctacaagaaggaatttgtctcaaggtggagtttgttgagttgtgatccaaattcatttgcacttaataaaggccagcttctgccgtagcggaacgaaggcccgtcgccgggatatatatatatatatatatatatatatatatatatatatatatatatatatatcttcatatctctcatgaactattagaaaaacccatagcctgaatgtattatcttatgctaaacaagttcatccattcgtaatcgtgtgcggtgtgtcgccgctcataccttttaaaagtaatatgtagagaaggtctgctgtcgaagagcaatttgttgtgtcattacctattattgttggtgagtctggagtggcgttccaattcatgacattgtccatttgcacttgtaagtggaaacatggagaaaactaacctccggagctacattagcacagattgaaataaacaaaattaaccaatcaaaatttataggcgatgattgaggaaagaaacgcacttgagattatatctagcaactcatgaactgaaactcattatccctcgagtactatcatcttgagatattgttgcttgctaactatagttatgaataagaaactaaagaaacggttgtcatcaggttaccacaaatttatgatcaaatatgtgttgggatgcaatgtacttctctcactctgctgagcttgcatgcatgtccattgacaaattcagacaaacagctaacaaactgttgttttaagctctctccatgctataatataatgtgtccatacatttaaatattcaaattttaaaatgatcaataattagtataatataaattcaattttatttactgaaaataatatcaatgaattggtatttaaatttactttcatatggttataagtttttcctacaaattttatactatatgagaaattatagaccaaagattagttttgaagaccatatcaggtttaaccatgtcttataggatggatgtagggagtacaaaatgtgatgggaacatggaaaatatgactttcttgaatttatattgcggcagccaaggaaacatacatgatcaatgggggcctttgggggttctcagatcacaaattagatcccaaagagcaaaaaagagcaggggtggctccgagcgatcaccccccatccccctatacactactctctcccttcctcctccccttattctctttctactacaccataaattaaaaaaaaaataaaaaataaagttggaaaaaattttgtatagaaaatactatatataaaaaatatttgaatttaaattcaaatttgaaacatgtatgtaaactttgggtctataaactaatatttgaattaaaattcaaatttgaatcgggtatgtaaacttttgacttataaactttaggtttataaactttagatgtatagaaatactatatatttgaattcaaattcaaatttgaatcggatatataaattttaggtgtataaactttagatgtgtaaacttgaggtgtacaaactttaggtgcataaatttactagaataggaaagtactgcggtgccaaaaaaagaacccacatggaggagggggggggggacgggccctgattgcctagcaaaaccgaaaaagagccatccctcgaacaactgacaatgagcccgaaattttgacaaattgacccttttataaaatttatttaaaaaataacccatatcaaaaactaatttcataaataaaccgtgacaatagcgccaattccgatggcgctgaggtcgaatccgaggtggcacaaaattaccacgtcagagggagctcagtgccactctagctggcgctgatataggttctggatatataacggcgcggaagagattcgaacaagtgagcggggcttaaggctgtgttcttacccaagtttcccaacccatctcccttgttttccgcgtgcacatttttcaaactgccaaatggtacgttttttacaaaaagtttctatatgaaagttgcttaaaaattatattgatctattttttaaaaaaatagctaatacttaattaatcacgtacgaatggaccgttccgtttcctgtgcacactgtgttctggatgggaacatgctgcagcgaacactcagtggtggtatccttaggcatgcatgtacggggtcgtgggttcaagtccttaccccatcgtgtttcgattgtttttttccacttagttccaaacttgctcttttaattttcttttgaaagtttaagtgtattttaaattcgttttatttttatactaagaccgaattatgaaaatttattattaccgaactaacttgtgggttacacggtacccggatacccaaggagaggtcttcgagccatgcggcatagggtggaccatgagctctaggctcatatggctatcttataaataaagaaagagagattcccgggataaagatataaatcttaggggtcatgcatagatagaatagagagatctagttacaatcaattagatactttccttgtgaccctcccccctcatcctatacaagagggggtagggttcctgagatcggggggctggggggaggatggcagcactttgcgccattcttcacatttttccaccggatacagataatccactacactggatgtatggtattacctcgctttgagagcttgaaccaggataatcatatgtcaccatctctccttgattaagcgcaccccataaaatatattgccgatcacataaattgacagttggcgcgtcagatagggtggcgcttgatcgttttcaaggcggagatggcttcaaccaccgattgccgggttattgttccaatctgtttttatgagttgattaatttctaatcaagattgatacactggtattttttttttgttttcatgccccgacgatctggcaatccgtccgcacgtctagaaaatccatccgctaccagacgatcgacgggtttcgccgtactgtagatcgcccgcgatctcgtccaggccgggcatgcaaacatgcatgtgtgcaggcaacctccgccaggacagatcaacaacacgtacgcacatgttccggccacgatgtcacggccgcaccatcatgacatcaacgtgatgtcatcaccatccatctacagaagcatgcatgcgatgtgacaaggacctccatgcccaacaatgctctacaggccttaattttttatctacatgtgcaagcatacatgtgcatctgttcctttcatctagattgatctagtttttgctggttgctaattccagattaatctatgactttgcatgcatgtgcccggcgtcttcaacgatgggagtaacaagcggccagttcctggccgtcaccaaattaatctactgtgttggcggccggctgttagcggtcacgcgcggcagcgtgcccgttcggccatccctggcctggcgtatacataaccatgcataagatcgattcacatgcatatgacatgtcagggaccatcagaatcagggagtagcaccgtatatgcccatccacatatatacgtgtggatttaattcattgatgctactaagattgatttccccttttttgtttgcacgtacgctcggggaatggtgtcgcacgcccggaggcttcatccttcgtgtggctgacgcggcccgatcacgcccgtggcacgtttgtccggaacatgacgccgcacgcccgggggctacgccgtcctcaccgcatgcccggggcttccccccttcgcggctcatgcggacccggttacgcctctatgactttgccgcggattcggggacttttcacctacctcgttatccgggcgctctacgccgactcgccacggactcgggggcttagggtgtgtttggttagatggatgagtctgaatgggagatggccgctcgattttttgtagtgtttggttaaatggcagggtggatggggaggcccggaatagggaatattccctcaatatgctggatgagtgcatccggccgatttggctggatgaagccatccagttttggactgggtgatgtgtcctattctaattggctgtggttggtttgatttcctgttaagcaacctccaaatgattttttctcctaaaccgtttatctaatttatgatttggttacaccattacatttgttataattaaatctttaaaacaagatctcggattattatattttgataaaaaaaacatatatgacaaataggcccactaacttttggctttttccatccatgctatatctctccaaccaaacaagaaattggatcgccatatccatacaaaccaaacaaaaaattgaatcgccatatccaactaaatatggatgaccatatcccatccatgcataacaatgaaccaaacacacccttagtctcccttgtcatccgggtgaccttcgccgacctcaccacggactcggggggcttcgccttccgcgtcgtccgggtgctctacaccgacttgctgcggactcggggggcttagcctccctcgtcgtccgggtgaccttcgccgacctcaccacggacccgggggcttcgcctcccgcgtcgtctgggtgctctacaccgactcttcacggactcaggggcttcgcttccctcgttgtctgggcattcatcgccgacctcaccacggactcgggggcttcgcctcccgcgtcgtccaggtgctcttcaccgaccttgccacgggctcgggggcttgacacccctcgctgcctgggtactactcgccgctgctgggtgatatgctccccgcgcaggacggctacctgtggcgtcaaccgaaggctcgcacctccgagccgaccacctacgccgccgtcaggtgatccgctccccgcgcaggacgggcgaacgtctgcttcgccgcctggtgacttcctccccgtgcacgatggctgaaacaactttcactcaacactactgagatgaatactcagccagtcttttctctcccagctggcttcaccaacctcagagtcatcgtcaagctaagtacttgggggctactgtgggttacacagtacccgggtacccaaggagaggtcttcgggccatgcggcataggggtgggccacgagccctaggcccacgtggctatcttgtaaataaagaaagagagattcccaggtgtagggtcccaaaactaacgattcagaaaccgacatgtttaattgtatcaagccctggataagtagattgatacaggttcaacaatctggatctttatcgcatacatttagtcaagactccaaaggagatatctttatataaaataatatgacatttacaagtttgtagctaactactacagcagaagctatacgatgacccaactctaccgttttactatagaattaaaccgtctaactatactagacttgaagactaggtttaaagggaactaacttatgtgattgaactcttagcttcggcaaaaactccaattaggctttgaaaaagaggggttgaagtaagggtgagtacaacgtactcagcaagctattatattattcaacaatgaatgcatgagaggtaatatctgtgtagagctagatttacttgcagaaggttgagaataaagaggtagaaatcctgaaatgcttgatatgcaacagcatttaagaaaatcttgaaatatatttctaaccaaagtaccatatgagtcccgatgctcaaatccgtgagcacgcctattcgaatagtttcaaggatattcatactccagtagatgtacgctttacccgctgtccataacttgccaataatcattagcttagtcatggcccagtattaggttattaacaatagtggcacctgttccatgaactttagtcccatacgctctgaacgtaacgttatcagcagcgagaggagttctggcgttcccgaggtttttcagagagaactggatgagagaccccacgtcatctcaaccagatttccataaaatcacacacacatcgcacgataatcaagatatttacctgcgcctcggtaaatatcacaattgccctgctcagcataagtttgctccttcgcgaggacttacataagaaccactatacagaggtaccacattattaattaacataatatctaggtctgtccccattctagaagctgcagtcgtactcattcgtttgacataagtacttggtaaacttatatcgactgagacagtactagccacctggaaatcaaccaaatcttatgtactgtcacaatctaaattcattatattttatacagtctaactaggcagggcgaagcaaaagctagcatagaactggtttgctatatgttcagattatgcattcaaaatcatgtatggctagtgcatataatagaatatagaatatagggcatttatgctcaaaagggaggaataataacttgccttgctccaacgcaaataaatccaagataggcaacctgattatctgattctcgcgacataccgtaggttgccatccaaaagacaataaactctactgagaaagagaaagaaccaaattcaataaaagccataaaataataacaaaacgataaacggttaagagggctagggtttaaggtataacctatctcttttatagggtatagggattatggggctagtatttggtagtggtaggtttaggtagtataatacctagggtttagttatatgggagtcgattgtggagtaggatagcatatcggctaggctctatattttgtgtggaggttctagaggattggtggctagaggggattaagcaactactgtcgcttatattttatgcgaaggctctcatggtttggacgataggaaaaatactagatagttgatatggttaaataggcatgtggctaatatgggtcaaggttgggctttggtagaatagtggctaggatttagttgtttaggccgatatcgaggtaggataaatatcagctagggttttgggtgtttgctagttgtcattagagttgggtagcatgacggctaggtttggtatcatttctagccgtgtcgatagaaaacatatcggctagaagaataggaggtgggtgcatgtttagtggggtggaagtgttactccgacaactgggagtggcggtggagtggctaggatcacacagagctcaagagttaactgtgtggtatgctgtggaggtcgagaaaatagtgaagctccgactgttgtacgcatagaggcgtggggtgccaggagcatcacttcgaccttaggtttggttttttgccgggctttacaaccaacggtccgacgttggggtccgtagactgtgcgaacgtccacatggaaggcgtaaagttccaaccggcggctttttagcggctaaagggtatttttgggtaaaaaggaaatatttaaagggcaaatctaagtttaaattggagattcaaatataagattaaatcaaatatttattcaaatggtatttgaataaattaaggaaattcaaatgaaatattaaaatagcaaatttggtatcaaaatgaagagttttaatttagatgaatttaggtccaaatttgactggaatcggatctacggtttaggagatatgggcttctaaaattgggatttgaattaaatagaaaaaatacgaaaagttactgttgatgggcccacctgtcaatttccttttctttttcttttctttttctctctccttctctcgtcttcttcttcctctgttcttcccgtgttctcttcgtttcttctctttccagccgagcaacagaggagaaggagaggaggggcgccgtctttccggcggctggaaggtggcgacgccggcggcgggtggtgttcccgagcatcacgcacctggggagggcggtggctggcggagagggagaggggcggtggtgagaggcggttgtagaggaggaagtcaaggaagacacggcgatggcagtggcgtggggaggaggatgacggcggccggttacttcgtgacgacggaaggcgttggcggcggcgtgcgccgtgcgcgtgtacaacacgcacacctggaagagggcggcttggctatgggccgatttgggccggctcggcttagctgggccggcagcccaagaaggaggaggaaaatagaagaaaaagaaaaagggattgggccaataggaagaaagaacggagtttcggcccgatggaaaaaaagaaagaagtctaatttaaatacttgatttggataactaggttttgcaaagaatttgaattcggaaagaattcacaaaagagatttcttaatttatttgagtgcaatatttaaaggtggagtttgagggaatttatttgggagcactcaaataggaagggaaatcaataatattcctcaaaatatttttgggaatatagaaggaaattagttgaaggcaataaataggatttgaactctaaaattggtgttatgtatatttgtggctaaaaggggaagttgagtgaagagtataagttggaattttcttagcacaagagcaattattcacaatatttgcaataatactattcttgtgccgaagaggaaatcaagccatagagattaaattggtggctagatcaaaaggaggaatttggatatttggatcgagaatcaaaggatgatggattaacaaataattccaataaaattggaatcgcttggttttggttcaagggcaaaattggaggatttcttggaccataattcataatagtgtaaatggttttcaaactaaatttgaataaaagagttttcaaatagaagaaattttagtcaaagaaagtttaatattcgaaaatagaattccaacaagaaataccaaatatgtttttaaatgaaaaacacaaaagagattaaataccagagaggttctgtgcgagttagttctaggaggtccctctaattaaattgtcctaggtttaggaagttattaagaacataagaagcggcatgatgcaggattagaaaataacacattttcaagatgttacaccaggataagatataaatcttggggatcatgcatagatagaatagagagatctagttataatcaacaagatactttccttgtaacgctccccctcatcctatataagagggggcaggggtcccgagatcggggtgctgggggagaggatggcagcactttgcgccattcttcacatttttccaccggatatagataatccaccacaatggatgtagggtattacctcgctttgagggcctaaaccaggataatcatctgtgtcaccatctctctttgatcaagtgcaccccataaagtatagagttaattggatccgtgccactacaaatatgctaaattagaaaaataccactaatattcgcaatatcgaccaggtgccactgaaattttgggaaattggatccataccactccgtcgtgtttttcgtccttcccgtcactctttctggaggccgagggcatggaggttggcgtcgtgggtgccggacggcagagccaacgggttgaggtggcagagcggcagagttgccgaagccgccgctttcttcgagccccgtcgacacattccgtcattcggccgagtacaaaggaggaggcgagattgacattggtggcggtggaaggctgtctctcggcggcggaggtgccattgccgatgaggcggtggatgtgcggggtcggggccttgtgagaggtggaggcggaggaccaccggagtgagagggcagcgccggtgcgagcgaagcggtcggggacggtgagtccccacgccataactgttacgctcccgcggcgcagttgtgacgacgtgttgtcgggcgttgtcaacaatgtcgacgtgttcgcgtgcaccattgccagcatcaggtcgaagccaccggcggtagcggcggcggcaggggttttgtcttcgtcggatggaggaggcggcaaccacctcaccaccgtgctgtcacactatgcagccaggtggctcccggacatcgcatcgtctccgtcggggaggttcctgctgtcgccgcaaagccccacggcgatgtggattatcactcatttattgatgaaggtgtaggcaggagaatggctagggtacagatattggataaaccactcagggtttaggtggctgatggggacaaatttcgtgtactcaggtaatccctaattgtggatggtggatgcagggccacatctttaaaagtgatttcgagctaattatgttggggggttatgacattatcttgggtatggactggctcacacaacatagtccgatgcaaattgattggggtcaaaagtggatagaattccattacaatcagcagttgattaggttgttgggggtcactacatagactactcattgttttgaaatatcaggggagcagttgcaggaatggctaagatgggagcaattatgtacatggttcagttggatgatcagcttgaaactaaggaattgcctattccccctgaagtgcaggagctgattcatgagtatcaggaggtgtttgcagaaccgacgggtttacctcccaagagacaatgtgaccatagaattccactggtagaaggagcacaaccggttaatttgagaccctataggtacaaccctaaactcaagaatgaaatcaaaaaacagattactgaaatgttgtagtcaggagtaattaaacacagccacagtgcctggtcttccccagccttgttggttagaaagaaagatggttcctggaggctttgtgtggattataggcaactaaacaatgtcactgttaagagttatcctgtaccaattattgaggagttgttggatgagttagtaggagcaaagtggttttccaaactggatttgagggcaggttatcaccaaattaggatggtgcctggggacgaacacaaaactgccttccaaacccattccggccactatgaatacagagtaatgtcttttggactgattggagcaccagcaaccttccagggtgccatgaatgctacttgggcatcagttcttaggaagtgtgccttagtattcttcgatgatatattgatctacagtcctgacttacctactcacctcaagcatctcaggactgtgctgcaactcttgaagcaggaccattggcaagtcaagttaagcaagtgctcatttgctcaacaacaagtgtcttatttggggcatgttattggaagagaaggtgtggcaacagatccaaaaaagatacaagatgtacttaattgggccactcctaccactgtgaaaaagttgagggggtttttgggcttagctgggtattatagaaagtttgttagagggtttggcttaccgagcaaaccactcactcaaatgttaaggaagggagtgactttcaaatggaccccagaagcagaggaagctttcaataccctgaaacatgccttagtgactgcaccagtcttggctcgtcctgactttgctaagcaatttactgttgagacagatgctagtgacacaggaattggagcagtgttgtctcaagagagccacccaattgcttttcttagtaaggcattgggacaaaggtctagggggctattgacttatgagaaggaatgtatggcagtattgctggctatagagcattggaggtcttacttacaacatcaggaatttgtgattttaacagaccattacagcttggttcatttggctgatcaaagaatccatacaccttggcaacaaagagcatttaccaagctattgggcatgcaatatgtaatcaaatatagaaagggaagaactaattcagcagcagatgccctatctagaaaggagccattggttgaaccctaagtttgggttgtatcttcctgtactcccacttggattcagactatagtcggtgggtatgaaaaggatcccctggcttctcagttgttagcagaattagcagttgacccttccgctaaaccacatttttccttacatcaagggttactcagatacaaaggaaggatatggataggggataatccagagctgcagcaacaattaatttctgaaatgcaccacagaccaatattggggcactcaggttttccagtcacttacaggaaaatgaaaggtctgttttcttggaagggtatgaagaagacaatcaagaatcaattgcagcactgccaaacctgtcttcaagctaagccagaaagagttaagtaccctgggctcctgcaaccattgctagtgccagaaggagcatgtcaagtaatcttaatggacttcattgagggattacccacctctgaaaggcataactgtattctagtagtagtggataaattctccaagtacgcttattttcttcctttaactcatccttttactgctgaatcagtagccaatgcattcatgaggaacatttacaagctccatagtatgcccaaggtcattatttctgacagggataagatatttacaagcctcttttgggagcatctattcaccaagtcgggtacagctttgcatatgagctcatcatatcatcctcaatcggatggacagactgagagggtaaaccagtgcttagagatttttcttcgttgctttgtgcattctactctaaccaaatgggctgcttagttacatttagcagagttctggtacaatagttcgtatcattcagcagtacagaaaactcccttcgaaatcatctatagcttccctcccagtcattttggaattagttctgaagattgtgtttgcccagatctgaccacttggctgtccgacagaaaattcacgcaccaacttatcaggcagcaccttcatcgagctcagcaacaaatgaaggcatatgcaaataaacatcgcagcttcagggagtttcttgcaggcgactgggtttatctcaaactccaaccctatgtgcaatcatcagtggccaaaagagctaaccacaagttatcatttcgttattatggtccattctaggtgttgagcaaagtgggaactgtagcttataaactgaatttgcctgatgacagccgtatccacccagttgtacatgtgtcctagttgagagcagcagtgggtttccagcatcaggcatctcaacaattgccagcacctctggaacatctgcagactcctcaataggtcctggatcagcacgtgactcgcaaaggtaacaaagttgttacacaagttcttgttcaatggtcaggtatgggggcggaagaagcatcatgggaagacatggaggagcttcgcagtcgatttcctcgggcaccggcttgggggcaagctggattccaaggaagggagaatgttagcaagcctgaagacatgcctggtacacatggggggtcacgtgatgacgacaaggaggatgacgaggtgtagggacaaggcgatagccaagaaggcgtcttcatcaagcaaaggcgcctgcgtaaaccaaacaccaaatattctggtcaggagtgggtcatgtaatgattcgggcccacgagcccatgtaagagggttggtgagtgtgtgtgtgagagagagagagaggggaaccaactgtatttagctggcaggggatactttgttttgattggatttggaactcgatgacggtgttggcggcggcggctctgtccgatctcgttagggttctaacaagtcccttgtcgccgcgctcccgctcgacggtggcgtcacatgcgactttctgcttcggcttctctgctctgggagcatggccggggccgatgcggcgtgtcggctggacctgagggcggtgaagctgctggagaacacgaggagcaagctcgccatgccgagcaactgctagcaggaggcgtaccggaggttgttcgccagctgcggcgacatcatggccgacaaggagattcagtcgcggctggcttggcacctcagttgctgcttccaggaggacactggccgccccccgttccctcactgcggcgaggggtccgacatggtgcactgccgcaagaggctcggcgtctccgaggaccaggtgttcctcgagaccaacaccctgtgccaccaattgcagtaagtacaactctcccatttcagtttgcaattcactgctgtttcttgaatttctttttgttgatttgtgtagagctgaagcatcgcttggcgttccgctgcgacgacgtcggtggcggcgacccgcccggtgcgagcacgatgctgctggatgttcccctcgtgctctgcctcgtgcgcagattcctctgcgagggtggcaaggccagcgcaagcggctgcctgcagggcggcgaggttggtggacacgtacctcgccgagctccttcaccaccgctcgcccggagtctatgccatgttagaacattgcttgctatctagcacatgtgtttgctcatcaatttgatattatacatacatgttgcaaataccagctcttagtggtggaattggtaagttggcatataatttatttgaagtatgatttggcttgtcggcgccgcctctcccctcgtcgacgtcagcgccttctttaatgcgcaataatccattaaggtgttttctgttaatagtaaaaacacagagaaacttctaaaattcataaaaaattaattcgagctccgcgtttaagtccattcaagtctcagtaaatccataaaaaaatggaaagaatccaactatataaggagggaaggacgccccttgagggtggaatcaccaaaagatcttcggatcaagactatatacggcggattcaatccgcaaacaggagtagggtattacttctcaatcgagaaggcatgaacatgtcaacccatgtctcataatccacccattttccttcttttgcgctatcccttttaatattgccgaattctagtttcgataaggaagtttggagacactccatgcctggctttgcagttgagagacacggttgaaactcgggccatagttgatggatgtaaagtggacttttttcccttcttggcagtgtttagctaatgggatatggaaatgatttcctacccagtaaaagacatctttaaaccttaaccattcattctccctcttccatttaatcctaacccttcattcatttctaatcccaatcccacccccatttcccattatccaaaaacaaaaagtccatatctctgcacgaatcttgatgacaaatggggccacaaaaattgactgaaatatgtgcttttttcagtcatctgaaaagtactcttttatctgtaacaaataccgatgctgaacgcgatggcaaaatattgtattgaatatcgatcagtctattatctgtaccaatttatctgttagcacggctgttcaaactgattgcaaatccgacattcggtttaattagatgagatcgtccctagagaaagaatcggataaagatatatatagaattgtcttgtttcgtgaggtgcccggaagtctccccaatatacatataggtatacaaactagaaaacaaatatccccaatatacatacaagaaaacaaacatagtccatatccataagtaattatagcagattaattttaaaaccgcgaaacatggttgtgtacgcatgagctagctagctctcgggactctttatcgcgcggtgcgcgctcgctgtccgtgctgaacacgcgacaaccatctaagcgtacgtacgttaaccccggccgtaatcttaggaccatcgacatgtcatacagtattcgtgtgtgtgtgtgtgtgtgtgtgtgtgtgtgtgtgtatatatatatatatatatatatatatatatatatatatatatatatataggacactcatatggggcaccatggtgcccgggcaccatggtttcaaatgcacaaaatcactcaaatttttcaaaattttcaaattgtgagtatatacctagttataagaattcgattcatacctatacctatcaacaaaacaactcaaatttaactttatttcacaatccatgattacatacctaactaattatatgtatgtatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccggggaccatggagcaccaaacaaatttactatatatatatatatatatatataggacacccatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcataatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatgagacgtgtagtcgcccggctaaagatcgatccgccaaaataaattagcagcttagctatttccatatccatctacctaaaaattgaagaaaagatcgatttctccgtgccggcggcctcagcggttcgttttgacgaccatcttcctagttgccgccgcttttgcgaccctgcagctcgcccatgcccagccaccagcgacacgacgtgaagtcccgtctctcccgattactttcaaccttgtgacccagacacatcatgacttctaccgcgaaccacgtgggatgccggccaggactagttctccacccactactacagaaagcgtttttgcatacgggcggaatcgatcttcacatgcggttggctggcccgcatgcgcgaaatggtctgcaaagatcaccatttgcgcatgcggccgtcgcagccgcatgcgaagatcgatcttcgcatgcggtcacttaagacggccgcatgcgaaaatagatcttcgcatgcggtccatataagaagccgcatgcgaagatatattttcccatgcggtcgacctaagaagaccgcatgcgaagatctattttcgcatgcgggcgtcttaagtagaccgcatgcgaaattcaatttccgaatagctaaaataatatttattctagcattttggtgattcgtaattaatattaaattattgagggatttattatcgtatttcggagtagtaagcatataagataagataagtgccgcagtaacaaacatgtaatacataaccattaattcaatcgtaatttacatacaaatatataatacaagtggcacagttttttcatcatatgtataagtagtgtacatgttattgcatatgttctttctcccactctctgagaggtttaaatttgtcgtccattgcgagttcactctggttgtcgtagaagagacctcttgcgttgcagacatcgcgacggatgaatcggcagaggtcagcggccacgttcaagatagtagtgtggttgaatcgttgtgcaatatatgggatttcggggatctgcacacagaaaggaaaataaaacggtactcagtgagaagtgtgtgcgagatgggtttctttgtagagaagagttcgatgacctactcggttactggttgttttgtacctcccatttactctgagcatctcgcacacgtaataaccacacaagttggttcctggtggttgtttgtagcactgcgatataattatggggaccgatctcagtagatatatttagtatatatgtactgttcgataattagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtccaatgatatgatcaattggtctttcggatatacaaggaataatatgtagtggtctctacatataagataggcttattggagacagaaaattccgaagaagataaattaattaaacaaaaagaagatagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagcttcgtggaattgcatactgtacaatgaataaagaagaaatgagatttggtttatttgtttcgaatgaaacgtgcaacatgtaataaagagttcagacttacagacagaaagccgcaacgagattaacgtccattttatctagcttgtagagggcgtaaaggtcttggaaagagataaaaaatatcccattaggaccactcatgaaagcgccttccgggacggcgacgcttatgaaaccgagacctttcctagatgccttcatataccattcgtgcattaccctcatttcccatggtagcttgttcataagataagttggcaagaatggcttgtcatactcataagtttcaggcacatcggcagataaccaggattgcacttcatcttgggccgctagtactgacttctgggagtctgacaagacgtgagcaagttcttttctcttctcagaattcctgaaagctgaaaacatgaacttctccttatccttgtcaatctcctttgggtcgtatgtcgatatcaactttggaattatacgacgaggttccaaagtattagactttggttcggatgtagtaccatctggtatgtgcacttgttctaccagagcagattggggtgtaggtggagaggtttgaactgagggcggagccgggggagcatgctgtttagttggggaggtgggagaggcttgaactggttgcggggtcgggagaggcggttgttgagaaggggagggtggtggtgtaggttggcgaggcggtgacctaagcggtggtggtgacggcggatgtcgaggtgacggtggttcaggaggcgacggtggtgcaggagcggcagcagtcattgcctgcgatgaggatggggttgaagatcctgctgcaagaacggccgcgctcaggattatgtctctgcggtgccacaagataaactgattcactgcatcaccgagaagttcaatcccctcaggtgcaggtatgtctagttccaaggaaacgtggtcgctatggaccttggcgacctatacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcattgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaatttgtctttgaggacaaaccccttacacgtccagagtgttcagccgtccccaacgccgcagtaagctgatctcgctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatctgttcttcttcgcgagctcggacatttttttcctcaaagccaatgcttcagctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcaacacttacggcctgttcgataggtatgtagtccggatcatcatcgcggggggcgacttgtgttatttccattggaaacgggtcacttggtgtgcgccacgtttcttcactagaagcgtctggctgcttattgctaccggaattttgaggagcgttaccttcttgaggcgctattggtgtgttcgatggaaccttttcgttcgacatcttccaacttgacgtaaaaaaatttgacataagtcccaattttacgtaagtcccaatttaacgcaatttcacataagtctcaatttgacataagtcccaatttaacataagtcccaattatacataaatctcaatttaacataagtcccaattatacataaatctcaaattaacataggtcacaatttaacttattttcacataagtcccaataacttaatttcacataagtcccaatttaacataggtcccaatttagcataagtcacaattaaacagaaatctccatttgacataggtgccaatttaacataagtctcaattatacataaatctcagtttaacaaaaatcccaattatacataaatcccaatataacataagtctcaacttaaacataagtcacaatttaacataggtgccaatttaacaaaagtcccaattatacataaatctcaatttaacaaaggtcccaattatacataaatcccaatttaacataagtcccaatttaaacataagtcccaatttaaacataaatctccatttaacaatccacaattaaaccttctcaaaattaaacaatccacaattgcacatatcacaatccacgatgcacaattaaacaatccacaatccacaattgcacatttcacatttctttttttaaaagtaaatgttaccgagcgacggcggggacgacctggcggcggcgacgacctggcggcggcgatggcaacggcgaggggggagaggtccgtgcggcggcgacggcgacggcgaggggggagaggtcctggcagtggcgtcggcgacggcgaggggcggggcgacttcggggaggagccggcggtagcggggacgacttggcggcggggacgacctggcggcggcgatggcaacggcgaggggggagagttccgtgcggtggcgacggcgacctggcggcggcgacggcaacggcgaggggggagaggtcctggcggcggcgacggcaacggcgaggggggagaggtcctgacggcggcggcgtggggcggggcgactttggggaggagccggcggtggcggggacgacggcgacggcgacttgggaaattttggcagcctggcggctagggtttcgcgggagccgggacttagaaaattttggctccccgcgctccctatatataggcgcagatcatcgcatgcgggcggcttaagggaccgcatggaaaaatatctttccatgcggtcgacataagccggccgcatgcgaaaaagatctttccatgcgggctgttaagccggccgcatgcgaaaaagatctttccatgcgggctgttaagccggccgcatgcgaaaaagatctttccatgcgggctgttaagccagccgcatagaaagatctttttaccaaaaaaactcatatttttttttctctaagtaaactgtccatatatatttttttcccaatatttcgccacaattatacattccaaatgtttttggcactaagaaaactcatgaaaattgctcaaaactcgtaatcaaatgttacatgctaatgattacaacataagggggacctaaattcatgcacgtacatttgctaatgattacaacataagggggacctaaattcatgcacgtacatttggaatacaatgagaactaaaggttacgaaataactatgacttaataaccttggcaacaccatctgctcgaacgtacgacatatttgcttcatcgattgttctctcaaccttcttaattcgcataggaagatcagtaaacaatggtacatcatcgaactggttgtaatcattggggtcttcgatgttgtcgatgccgacgatctgttgctttccggatatgacaatagtttttctttcatctgaagggtccttcacataaaacacttgagccacacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccatatttcttgaatggtcccataatacgacctcttttctccactcgtgtcaatcgcttcgacacggatcccactgttttgtgtggtgcttttcatgtccttcgtagtcgtactcaaggtaaatccattgatgtcgtaaccttgccatgaattgacaatacttgaaggcccacatgccaatctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaatactttctgcgaaattcgattgaaaaagtagcacaactttgttataaccacctttgtatggactggtttgactgcccttatagcaattggtaggaacaccgttagcaacctatgacagtcatgcgcattgtatcccgaaatggacaaatccttcattgatactagcttcctgatgttcgatgcgaaaccagtaggcactctaaccccttgtaaacatttacagaaggcttttttctcatcaagtgtcaacgagtaacaagcaggaggaatctcggtcttcccatttggcagcactactaggtgaaggtcatgccgtatggacaaatctacaaggtcgttacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtatcgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatatcagacatccagtcttccctttaatctgcccagataatgaaaagtttgcaggtaggtcattgatggtaacgaatatgatcgcacgtagattgaagtgctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcgagcgtcggcgggatgtcgaatcataccatctattttccggctctcttgatgccatctcatcaactcagcatcagtcgggtttgagtacagacgcttcaagcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcttgccaattctccaatcctcgtgacctgcccgctagcacctctggttcaacatggcgtagcatatcctctaaatcaaaaccaccatcgaaatcatcactatcggtggaaacatcgacaaccattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgtatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaacgtacaattgattacatgcaaaatttgcccatcaaaacatatattttgaagctagattttgcaaaaaatagttagaacaaaccttgtcaaaatattaaaaaaactccactttccaccaacgaaatataacaaaaatggagccaaatgaagcaggatagagagttcttcacctttcgtatagagttcaagtaaaaatttcgagttgaaaacctcccccctaattggtgcttgctttaggagaaagaaagcttcgttttcaaatggtcaagctcgggcctggaggagcatatatggccgatcatcgcatgcggtcccttaagccagccgcatgcgaagatccattatcgcatgcggctgcttaggacagccgcatgcgataatgggcctattttcgcatgcggccgtcttaaggagccgcatgccctaatacatgcggccccttaagacggtcgcatgcgaaaatagacctattatctcatgcggctgtcttaaccaaccgcatgcgataatggatcttcgcatgcggctaatcaacccgcccccgggggggcggtttttgcaggtgccgccacaagcggcccgcatggaacctaccgaccccctcgtacaccaaccccctcgtacagaaaaacgatttttgtagtagtgaccgtacgacccaaccgatgtgatggggagaaacgttctcgggaggaggcgtcccgcgttcatcagcgtgccatggagatgggtcatggtggatgtcgtcgcccccagggacgccggatcacatgtagagatgatgaggacgacattagcaattgccgatgacgatctatacattcttggtttcgctaatcgcaccggccattggcacgtcatgaaagattttggaggtttaccagaaccactcacgaagctaacgattgaacatagctatggcgacctggttggtagtttccagaatctccacacagttcctctgggaagggagtccgccgtacaagccgtcagaacacttgcaaactacaacagcgccatggccgaagcacaactcaaactgccgattgccaagtttgcgatcatgatatctgaagccctgcggttccctttcatcaggaatacgttcagtacaaattgggagagcgagaccttcatgaagccggaccatgtgaaatacgtggtttattggggacggctctctaaggccctagtgtggtggaagcaaagtggaaataattggtggccacgtccagacagcgaccttggtgaagactttgaatacattaatgtcaaaacgtcacaggatgctgtgaagctagttgatttgctgattcgcccagcttcaaggtactcctagttttttttagtttaatgtatgtataatttcaatatagatagaaaatagtagattttgtgcacattagtgcacacgctaggaatctctaccatctatgtgttcctttattatataagtgcgtgttatatatatattaaaatgtgatgagtacggttcataataaagttctcaatctttttctctccaatgattagaatgtgtaacattctccctttgttgatttttttaatagactagcagaaaatacctgtgcgttgcaacggaaaaaaacttaaataaaaataaacaattagggtttaattttcacggtcgacgccctttaagaaaatatattcttctgtagacatgcaaggtataacatattcaaaatagtttatttcttgaacgtaaaccacaacgtcaattataatttatgaaaaaaggcctaacttttccttgttgattaaatgtaaattaccgaaacgcatcccgaccaagcaaactatactaccttgtttattttttatgtttttcctctaccgatacgtttcagtgcatgcgagcaaggataaaaggagagagagagagatagagagattgaacttttatactactatactagctgggcgcctgtgagttgcgacggaaaaaaatctctatgaaatttttaaacaattttatacgatctgcaaagtatccacacaatggatcattcaatggctgcaagcttttcgcctgttttgaacatactcttcatctgactgcagcgaattatcagcagacagttgagttcaaaaggaaaattaaaattctttctgtattggactaaaaaaaacttgatatatttattactttttgaaaaactttttgagatactacattgattaatcagaatagaacgtgatatatttattacttcctctgtcccatgtcccataataagttaaactttcctatgtcttgttatgtcatatccagtacgaaaagtcaaatggcatatttgcaaaacaagtaatttgtgaataaaacgtttatatacgtgttcttagtgatatgaaaacaaatacagaaaaataatgatgaaaaaaccctctaaaatcagctttaaatttaagggctaaaatttaaattttggctaataattatgcataagcgaaaagataagaccctagataaacttattttgggacggaagtagtactatccttctggataatgtatagtgaaagaacttaattaaaagtgccggaggtgttgtcagtagtcagcacataccttatttccaaaacaagagatcagtcttgttattctgttgcaatgaaaaataatagcgtacaacacacgaaaatcctaaatgattaacagaaacagacgattaaatagggctctaagtgtaaagcaatatcatgattatcttttacaagtcatgcaatttcatattagcaaatctattttatacccccatagaataagtattctacatcttctctcatgggcaaaccgcaattcccccacccttcctagagcccaatccttcctcccacctcgatcaaagggcagtcaaagcatcctcccgccggtcagaccccagtcaaacctgcttgtatgcttccccacgtctacctatttgatgtcctcgtctcacaggaattgtgttgtaccaagacgatcatactatagtaacaagattgctttctcgcagtaacaatattataacgttgtcaaaatatagtgatgacggatgtagttttataaagctcttttttttaaaagcaatatggtgaaaacggttcaaaaatataatatgtgatatgagatatatgatcgtttaaagattagaatttcaaataatccacttgtatttagtttgctactgtgtatcatgtgtgtgcaaagtgaagtatttttagcactttgtcattgttacggataaggcataccttctatcctacgactaatgaaatatgcggatacgacataccgtcgtatgtatggtatacttctatatacgataaggaaattaacaggagataatgaaaattatcctcacgggggcaagtgaataacagaattctactcggagagaattgggtttatattatatcgttttctcctagttctacttggagaccaaggtgattcacggtataaaaaggcataccctgtgaggggtccagatcaccgaatcttatggccaacactaccaccatagtcttcaagccggaggatgcaaagcctactcgctgggagatctcgtcgaatcatctcgacaaggatctcgtcagtaacatcgggatcatctattctcattctactatgtggttttccatatcaatcacatataaactggattagggctattaccttacgaggggtctgaaccagtataatctttgtcttcttgtttgcttgatatcgtattgtgtatatcctcgtaccaacataccccaatactcccatccggtctacgggtatcacatgtcgacacattttatgtcagcttgcggccatgcacctctctaactaaagcaatagtattacaacggtactaccataagattgggattattaaaatctagctctacacattctgtagtactatagaaataccattactactacatgttctatgttactacaatttccacaggatgttactgtcaacagtgcagtaggggagggagccgcccttgcccatcgcctcccctcccgtcagaaaggagggcgccgccgccagccaccgtcgagccgtcccgtggccccatggcgagggagaggaggtgaggggtaaacaggtgtcgccgcccgcggaaggagatccgccgatgctgaggagcagcttgccggccgctgctccctagcccacccgtaccgttgctcgcgggtagagggagaaggagagatgaggcggagaggataagggaaagagagagagagagagaggggggagggagaggggtaatgaaagggggagatagagggggtgtggttcagctcagtcagctctaaagtcagtttttttaataggcatcatttttttaataaaattggcacctataatattgtttgaggcatgacacgagggccttcggccagatctgcccaaacaatccaacccgtgaggaatcaagtcaagaccaagaggtttgactgggcgaagccacatggcgaactgtatggcgaagattaaatgactgagtctaagctcaacaaagcatatcggtcgcgggcgaaggccatgactgaagtccatggcgaagcccctaggcaaagcgtgaaggcttcgcctgaagaagccgcacggcccacggaggcctttcgacatagctgggccgacctagctagcccatttggagcccataaatgtaaaggacactgtgtgccctcactaatgtccctatcataagggtatccatataaattcccctgtacaacctaaaccctagaaggtgtaagcctgtattaagactgtaaatagccccctaggaccatataatgggggatccaaaaaattttaccaattaatacaatcgtttttactttccaactacctgatgagtgaaccacgtcaaagcggttgtcaatcgacaacaaatataaatatagattttttttaatttttaattttttattaaaagttttacaaaaataattttctatttgaaaaattgacaaaactaacctcccgctgtgtcaggccactcgggctatatactgaataagatactaaacatgacagcgtgaaatatttagttggatggggtctcaaataaaaatccaaatgataggtaattaataacggtaaccatccaacctcatcgctgccctgaaatgtcgaatatcaaactcaatataaaacccaaagcgccgagtaatgaatataagaaatcttcgaaagaaacagcttgccagtcaacttcactagtacagatccttccatctgtggtggcctctaacaagcttggaaatagcgggccgtcacaagaaagtcatctcaatcaggccgaaaaagtgctcgattaagatatggtcgcacagacatgttagatgggcataaaacttaggcccgtcacggatgacacctatcagtgagggaccgtagtttaggcccgattgagataacattccatatctcaaacgggcctcaagttggggctcgtcacagatgaccatcatccgtgacgggcattaactatagatcgtcacatataagggtcctctgtgatgggctatagtttaggcccgattgagatgagtgtcatccgtaacggactctagttgaggcccgattgaaataacaactaggcccgtcacagatgactcatcagtgacgggctatatactaatgcccgattgagatgacttaatctctatcgggcattaactaaagcccgtcaccaatgagtatttttccatttttcatatgaaatgtttatatttgtaagttgaactatagcaaaataattaattgcagtataataattcattttatgagtcaaaataattttacgggtagtaaatgatttcaaatggaaaaattatcaacaacaaagttgtataacttatcaagatttacaacttttagtttggtcatttttctatataacattttttgaacagtttgaatttgaatttgaaaatatgacaacttcaaacaatattttcaaatactaaatgatttcaactgaaaaagtcatcaacaacaaaattgtatatctcatcaatatctataacttttagtttggtcatttttctatataacattttttgaatagtttgaatttgaatttgaaaatatgacaacttcaaataatattttcaaataataaatgatttcaactgaaaaagtcatcaacaacaaaattgtataactcatcaagatctaaaacttttatttttgtcatttcttcatccgataaagtgttagtaacattgttcacagtttttacatatatgtgttatggtttataaaaccagataagagatatgtcaattttgtgaacaatgttattatcactttgtcagatgaagaaatgaccgttttacatcttgatgagttattcaactttgttgttgataactttttcagttgaaatcatttagtatttgaaaatattgtttgaaattgtcatattttcaaattcaaattcaaactattcaaaaaatattatatagaaaaataaccaaaataaaagttatagatcttgatgagttatacaactttgttgtcgatgactttttcagttgaagtcgttcactaacaaaaaattctatttgaatttctcaaaccttgaatttcaaatttcaaattgttcaaatagagttagatggaaaaataatcaaaataaaaattttgcatctcgatgagttctacaactttggttctggtgacttttccatttgaaatcatttattaatcccaatttttgttcgaagttgtcaaattttgaaaattcaaaatttgaatcgtccaaatgaacttatttgtacaaaggaccgatacaatagttgtagatctcgatgagttgtacaattttattgtttgtgatttttgcatttgacacacaaaaatcagcctaaaaataaatttaaagttctcatttattgaaaataaaaaataccacataaattaaatataaacatttcatatggaaaatggaaaaataatcatcggtgacgggcattatttgaaactaaagaaacggttgtcatcaggttaccacaaatgtatgatcaaatatgtgttgggatgcaatgtacttctctctcattctgctgagcttgcatgtatgtccattgacaaattcagacaaacagctaacaaactgttgttttacgctctatccatactataatataatgtgtgcatacaattaaatattcaaattttaaaatgatcaataattagtataatataaattcaattttatttaccgaaaataatatcaatgaattgaaatttaaatttactttcatatggttataagtttttcctacaaattttatactatatgagaaattatagtccaaagattagttttgaagaccatatcgggtttaaccatgccttatattataggatggatgtaggaagtacaaaatgtgatgggaacatggaaaagatgactttcctgaatttatattgcggcaaccaaggcaacatacatgaccaatgggggccttcgggggttctcagatcacaaattagatcccaaagagcaaaaaagagcaggggtggctaatgggcgggtgaccgctccaggcgatcaccccctatcccccctatacgctactctctcccttcttctcttcctactacaccataaattttaaaaaaaataaaaaaaacaaagttggaaaaaattatgtatagaaaatactatatataaaaaatatttgaatttaaattcaaatttgaaacaggtatataaactttgggtttataaactttgtgtctctaaactttaggtgtataaactttagatgtgtaaacttgaggtatacaaactttaggtgcataaatttactgaaataggaaagtaatgcggtgccaaaaaaggaacccacatggaggagggggggatcggccctgatcgccccgggcaatcgctcgcccagtagcacaaccgaaaaagagccatccctcaaaccactgacaatgagcccaaaattttgatgaattgaccattttataaaacttattttaaaaataacacatgtcaaaaactaatttcataaataagccgtgacaacagcgggtcatgcaggtacccaaggagaggtcttcgggccatgcggcatagggtggaccacaagctctaggcccacgtggctatcttgtaaataaagaaagagagattcccgggataagatgggagatagcagtatagggagtccatggaagtaattggtcgtttggggatcacaaaactctgggagttgagaaaattggtttggtttggaaaacatgctttaaggccaactctgggagttgtgaaaacttgaaaataaaatttgtcacttctcagccctgaccgagctgagacttgtgtcactttggttatagaaagcacacacttagattgtttaaaaattgaaaacaaaatcgttttcaaaataaacagtctttccttgaagcttgcaagagtgacataagtacccctggcttgctgagtatgtaagtgctcacccttgctctctacatagtttgccagctttgaagtgaagttgaagtgaagtgaagtgaatattagggttttgttctggttcctagcagttgcctatggtattggaagttagttcatcggttcccattggctatgctgttgttgttgtttccgcgtcgccggtttcattgtcgggcttctcttgggagttgcaacttaagtcaagttaaataagtcatctatttaatttaaagattgcaatgattcataattgtcaatgtgagtaccaacgctatgttatgggactagtgccgatatcgcagtctcgtaggaggtggttcccgtcatttttcctacgacatgctcctataaggtgtcgttgtatggtgatgccagattaaggcgtgacaaaatactatgcacacgcagggcttttaaacaacaatttagtgagatcatagatctgccattgatttttcatttctttgagcgtgtgtaggggcgcattcgcaggtgtgtgacatgtgtgtctacaatgtaatcaaaaaatcaaagtcgccctagttaagggaggctaaacgaactttcctcggaaaaaaaaagaacggaggggttttagccggaataagttcactttatgaccctcaaatgtgatcgaaatctaatccgtgaccctaaactacaaaaccagatatctcgaccctcaaactcctaaaactggtgcaatttgactccctcggcggttttgagggtggctttgctgacgtggcaccacgtggtgcctacgtggcgatattgaccaagtcttcattccacgtagcgttgatgtggcacctacgtggcggtagaaattaaaaatatgcgtgggacccattagtcattcacacgaaaagaaatgtgggcccacagacatgtgggtcccacatgtcagtcctccttcctcctccctctctcctttctctctctttctctccccttcttccctttggccggtggcacgcggcgacaagcaagtttcggccgacagcaggcggcgagagcgagcgacggcggcgtgcaagtaagtcccggagcggcggcggcgcgcaagtgaggggagcggcacgccgtggcggagcacgaggaggcggcgtgagaaggccgagcgaggaggtcgagtgaggaggcggcgaaggaagccgagcggagaaggccacggtggagcgcgaggaggcggcgaaggaggccagtcgagcctccggtatccgcccccggccccatccctcacgccgatggcggtggcgcagctgctgctgggcgaggacgggagggggtacgacctcggggacaccgcccacgcgtctccagtccccatccacttgggaagccttcctcttctcctcctccggctgtggctccgcgcccctgccccctcacccgctcctgctcctccagctccgcgtccgcgcgctcctcttcgacaaggcctccgccgcgctcctcccccgtggcgcctccccagcgggcctcaactctgtcaacgccaactgtgagccccaactcttgcatgccaccgtgcgccaccggccgaagggaagaaggggagagagggaggaggaagaaggatgactgacatgttgccccacatgtcagtaggcccatatttctttttgtgcgaatgactaatgggtcccacatatattttttaattctaccgccacgtaggtgccacgtcaatgccacgtggaacgaagactcggtcaatatcgccacgtagcaccacgtcagcaaaaccacccctaaaactgtcgagggagtcaaattgcaccggttttaggagtttgggggggtcgaaatatccggttttgtagtttagggcctatggagggacttttttttttttgtgagagggaccacctaaacaaccccttagatttcgatttgagggtcataaagtgaacttattccggttttagcctgataaggcggccacggcccacgaactagtcgagtccccgtaatataagcagaggccctccgctcaatcccctcatcacctgccgctgccgctgaagcgaatcgccgccgccgtcctcgaatcgtcgacccggttcgtcttcctccccgcgcgcgcgatccatctattacagcctcgaggtgagataaaattccgtttgtcctcctgttctaaggttgcatgcgcgttctcattggctccaatggggattttcttttcttcagtaaatttcttgatgtttgggggcggcctgggcctgcgcgtgctccgatggggattttttttaggtaaacatgctgatgttcgcgtaaactaggtttgtgtgttaccctagcgcgtggtggttggttgcttgcaatgcgattgattaggttttgcgtaatgggttcgatcggatgggttgtggggttgggcgaccagaagatttatgagtagtagcgtcagatcagttttagacaattaattggttgcatcttttctcttgatagtccgcctgttctacacttgtgctacctgtaggtagagattgttaatttctcatatatagcaccatgtgctgatccttaattttgttggtaatttgtatatgtaaaattgttaaatttttcaaactcttttctgctcgctccaggctgtcgattaatctcctggctatttacttgagtgttgctgcctataccaaagagcagtccattagcgcgtgattaattaagtattaactttttttaaaaaaatagattaattatattttttaagcaactttcatatataaactttttgcaaaaaacactacgttttgcaatttgaaaagcgtgcgcgcggaaaacgagagaggttagggagaggcaattaattatattttttaagcaactttcatatataaactttttgcaaaaaacactccgttttgcaatttgaaaagcgtgcgcgcggaaaatgagagaggttagggagaggcacaaacgaacacagattgtgaactcaggcactttggggttgataactttgtactgtagcagtacaatgttttgtctattaagaactaaaggatgggcccataactaagatgggagggtgtatagagttatctgtatattattggttaaattagcatgtaacgttctacatattggtttagtatatgtaaaaccttttgctctgcttcagcttatttgtgctctgcttattgatatctttatgttaacacacagatatatccatcttgcgctgccattgcttccaatcagagaccggattgatcaatgaacaatatggaggcggcactacctgaggacttgctggccaacgtccttggccgcctcccaccgtgcagcctcgccgtgtcacgctgtgtccgcaaggactggcgtgccctcatcgacaaccgacgcctccttcgtgctgacctcctccctctccgcctcgacgctttcttcttcaagggccagatcctcacgtctcacccctacttcttctcgtcacgctctacggcacgccggatcggtggccgcctcgacttcctcgacaccttcaatgacgaagatctacagatcatggatcactgcaatggcctgctcctgttcttcgagcggctcgccaaccctgccactcgccaatggatgcacctgcctaccttcccgatgtcgccatgcgtcacgctgggcttgcgcacgggcttctgcctcgtatgatcccatggtatcgccgcaccactttgaggtgttttgtgtccctttggttcccgaaaacatcttctatagaagcagcgataatttggaccccgacagcaacagcagcgttgatcaggagtcattagaatggccgttgtcatcgcggtgcacaacacacgtcttctcgtcgaggaaatggaggtgggaggagaggtcatttgtccgccaacaaggagtggagcctgccaatgagaccattgccgacctacaatttcatccccagcaattccaacgccgtgccttatatttgaagggagaaatttatgtgcaatgcaagaacaattctcttatgaggtaagtgaataaatctgtgagcttttttaatggtactagtaaaaacacttagaacttcaatgatagaagggtttgtgaacataataaatgttaaaaaaaatcatttaggacaaaatatagttggttcatgaaacaaactgatgttgctggtgggtcctgtaattatggacaccttcacagcttgctacctagcacagagagccagtctccaagccagaaatataaaactgaaaaagaaatactcgctccttgtatgcatgattttactgagaaatataaaactgaaaaagaaatactcgctccttgtatgcatgattttactaacatgctttcttgttaatggctcaacctcaatttgcagaataaccctgtcaaatgataagtaccaaatgatcaaatcgccagtagagagcaaaattgatgatggcaacggcgtccttcagttgggaaaatcagagaaaggagtctactttgtgttgcttatgaagataataatttcccccaatttcaagtttggttgctcaataaatcttcatcatgtggtggtcaggttgagtgggcgttgaaggctaacatcagccttgaagcaattatggataattttcctcttaacactgacaatagtttcagcagaccatggatcctaaactatgtgaccgaagaagcaatacgaagggcacaggaggaggaggaggaacttgaatgggactttgaaaatggtatcatccttgaaaccaaagataaggcggaagcacaccatcttaataatatttattttatagggtttcatccttacaaagagattgccttcttttgggtctcatcatcaagagtgatatcctatcatttgaatacctcaaaggttcaagagttgggcatcttattccatttacccggtatagcgcagtcatttctatacacaccgtgctggatggaactatttgaaaataacaattagctgctagctagtagttactttatcaaagttagcacgtattcatacacatttaaataaatatgttcccttttaatatatatatgtatgaacgattgtttaatttaataattcattcctagctccttgcgttgataataattagagtgatgcgtgtctcctattttattagggttaaattgatccgtgctattacaaatgtgctctgttactgtcactgtcgtgtttcgtcgacgggtcgagtggtgatagattatactcttgttttttttaaagtagatgatgcatcggaacatgtaagacacgttaatgatggggctgtattttttaccattcgtcctgttttaaaaagtatataaatattatttattttattgtgacatgttttacaattaaataaactttaagtgtgacttatgttcgcaattaacactattttttcaactaagatatgattaaacgttattttaaaagtcaactgtactaaaaaatggaattagtatatattgagtaaattgtactgcacttggcctacgcatctacttcctctgtttcataatataaaactttctagtattacccatatttatatagatgttaatgaatcaagatatgaagggatatataattatatgcttcaaaccactctttaattaagctatgttttactttgagctgccaaaacgctccttaattacgtgcgaccaagataacaacagcataatgttttaacgagacgtcaggcttgttcacttgatagacaaaatcaatcttactaacatttggtaataccgaattttagtttttttttgtgtgttataaatttttggtagcattagatatgtttagtccgaaacctttctaaaataaatttggtggtgttttttagaggaaacttgtaagttctgttttttaatggaacttcattccaaccatcacaacctagaaaaattggacaacttcactctgcaattggttcactgacataaaggtttctttcagtaaggtcattccagttgtttgttcagtggttggttgctctagaacaacgacgtgcttcattaaaaatgaatgcaatccattcagtcgctttactgcagccgatctcctgtatcaagaatcaagagtcaagacacttttgtttcatagtagtagctcatccattcctgccttacttctgatatcggccttggctttttttgcctgtttagttcccactcagaaacttttgaccctgtcaaatcgaatgtttggacacatgtatagagtattaaatataaaaaaataattacacagattgcgtgtaaattgcgagacgaatcttttaagcctaattgctccatgatttgataatgtggtgctacaataaatatttgctaatgacagattaattaggcttaataaattcgtctcgtagtttacaggcggaatatgtaatttgttttgttattagtctatgtttaatactttaaatgtatgttcgtatatttgatgtgacacgctaaaactttgcatctctagttctaaacacacagccttttggcacttcttcttttccttctttgagctgtttatttagcagttcagacttcagagttcagaggtctgcaggctgcagctgcagtaaggctaaatggctggggcttcagagtgagtatggctgaggcttttcctgacaatcaaaatgaagagttattagtgcacgattaattgagtaatgattaatctctatctctactattataaaagttaaaaatattttcgctaaaattttcgtacgtcgtacgtatttaagttgattctgtcacccgtataactctaaaataactattatacaccctcttccccgcctaacggcctaacccctccccctccctctcccggtccaacccaacccaacttacctgtgttttctgaatgcgcgaaacagaaggagctgaattaacctacatgacctgatttttgcctgaattctgctcttttcttagacatgttctttggtatttttatgcaccctgttttatttttttccacaccctctatgaagaaccttgttgtatcagtactgtacgtactgtacgtatatgatgcagtagtaactattgttaaacaggagaaaaatgaaatgtaccggccggacggaagaatggtcatattttctgtgtcagtcaaaacagaagaatgatcatatcttcactatgagaagttgcccatggccattcaagccactatagtgtagcactgaaccatcacaagcttgaaaaattagaccactgcactgaataatggcttgcacaaagcaatgacattctgcaaatggttcactggcattaaggttttctaaactttttcttcaaactttcaacttttctatcacatcaaaattttcctatacacaaactttcaacttttctatcacatcgtttcaatttcaaccaatcttctaattttgacgtgaactaaacccaccctaagatcactcactctagttgttcactgggttggttgccatagaaccgcacatgcgccgtgtttaattccaaaataattcttcaaacttctaacttttccatcacatcaaaactttcatacacacataaactttcaacttttccatcacatcattccaatttcaaccaaactttcaattttggtgtgaaggctcagtaaaaatgaatgcaatccattcagtcactttactgcagccgatctcctgtatcaagattcaagacactcgcttgtgtttcatcacagtagtagttcatccctgcctgacatcatctgatatcgcaaatcttcatgtgtcagccttggcttttactcgagccattgccacttctttttcttctttgaattaactgagctgtgtacttgagcagttcagacttcaaatttcagagacctgagttcgattcagctgagggtgtgtttaattcacaccaaaattggaagtttggttaaaattggaacgatgtgacggaaaagttgaaagtttatgtgtataggaaaattttgatgtgatggaaaagttggaagtttgaagaaaaagtttggaactaaactcggcttgaattggtgttgcttttcctcgcacataaaacaagttgagatattaacacatgattaattaattattaattattataagcttaaaaaaattttatttatttttttaagaaactttatatagaaaattttataactcagcgatgggtcgggcatattgggctttttttgtgcatatacacacactaaaagcccattatgatttcggcccaaggcccgctagcccgtaatccgtacgaattaggatgccacgtggcatccctctcctctgcttcgagaacttcctctccgctccctctctgctctctcttttggcccaagtccctatcacattgaatgtttaaaaattaattttaaatattaaacgtagactattaataaaactcatccataattttggactaatttgcgagacgaatctaatgagcctaattaatccatgattagcctatgtgatgctacagtaaatattctctaattatagattaattaggcttaaaaaatttgtctcgtgaattagcttttatttatgtaattagttttgtaagtagtctatatttaatactctaaattagtgtctaaagatagggactaaagttaagtcactgatgtaaacaccacctttgtctcttcttcttcttccgccggcttctcttccaagcctctcgccttctccctcccgcgctcgccgccaaaacccctcgaaaccctaggctgcttcgcttcctcctcctcctcctccgctccaatggcggacgtgctcctcccggagctccgctctcctcctcctccgccgccgccgccgccaccgacaaatgatgatcgcgcgcgggcggtggacctgccatcgccgactccggagtgtgacgatcgctcgccgcgtcgtgagctggggcgctcgccggaggatcacggcgtgccgctccctcccccgccaccgctcggctcctcgcgccccgagcgcctcgccagcgatcgtccggaggagggcgcctccgccgccgcgcagccgtgtggcggaaggagtgagagccccacggcgaggtccatgtggccgcggaggctctcccctgcgtcgttgccgccgcgtggcgggaggaggagcgagagccccacgccgaggtccatctggcggcggctctccccgtccccgcccccgccgctgccgcccttgcctcccaagcggccgcgcttggacggccgccgtagcccaccgcgcggtgggaggtgaggcggagggaggacgttttggtttaccttctcggctctcgtcggtgtttgatttctcctgcgaagatctcaagctaatgtgtgttccgctcgcgcgtgtttcgtgcagattcggattcgagcacgagcgaggcagggaaaggagcatgaacacttcgcgtcgcgctccaggtgagctatacttgttgaacattttcatcctgccccttctgggcgcaggcatttccaaccaaaatcgtgccctgctacaagtttgcatagcatttctcaaagcagagtttctggttgttactttgggattgggaagggatttctcgagcacttagacagatggaaactgatcagtatggtttgaggtctccttcatcctggattcctggtagctcaaaatctctgggcttgcttggaggccaatgtgagaattttttttctcattccatcaaaacaaatatactctgtgtacttcagtagttctcatggtgaaatggtgagtgtaattcgtcagttagtgctttggcacgcttttcgagaacgaggagcctgggacattaagcacttactaggtgtcttgtactcttgtgtgatttcataatactcacctcggctgtcaactcaatgctatcagaattgcagcatgcatctttgtattagtgaaaaatttctgatgtcctcagttttaaaaaagaactatgccatcaatcaacactaattttattggcacactagtaggtgattatcttgttgagttacctatacactttgataaataggagttggcttcaatacttgtaaatttacttgagaacaagagagctagtggattgctatcaacatcgtgcatgtttcttgttggcttacctctagtcacaattgaagttcttagtatgaagcattttgacatcgatctattatttatgattaacctacttctgcagtattagataaaaagttaacattaatactctctctctctccccctctcttcattagtaaaccttattggttatgtgcatgaggacataggccggagatataaacaatttcaatgatctaataataattcatggtccttcatgtgagtatgtcttgtaagaacgacgattcactgctagaagtcttaacacttactgcttttcttctagattgcctggattctggatgtgatgccccctataatggtcaaagtaacacccggaggtatgtatatgattgccctatcatggtggtagttttgatctgttaggtatgttgatattgctattacttccaagtaatttgctagtgtggtgttgcattttgttgaacttttccttcctttttgtctttttttccgttttaaatccctcatatattgttgagtggatggagtgccaattgtatgagatcttatgtgattccaaatcatttcaggaaaggattgatgacatacaaacagtttacccaaaaacttgaagatgatgtttcaccgggtgaagctgagagcaggtatttattaacaaaaagttacacaacattccagaacttgaattaatctgttgtactagattgcacttaaagttcagtgagctatttgtctaagtacactgttatcaacttggttaacaaggtaccaagaatacaagacatcatacattacttctcagaaacaggattattttgatcaccataagaatgaagatcggtatgttcaaaatgcacttcctttccttctggtggtgttaattgtactttgttaagtaaattggtattgcaggttcatttctttgtttttgtaattgcagtttgaaagacatgtaccacccaacaaacttattatctgttattgaaaggtaataataagtttgcttaaagcttcactcagaagtttacctgctgtcagaaatttcgtatttgaattcgtattgagcagcattcataaaccgaacagcgcttttttatgtgcgctattcatttcgctcagaaaaggttgtgttgcttgttggtttcttatgtctgtttttatttcactcaggcggaatgaactttgcaaggctgcagcgaagaatttgattcttgatttgcggagtggaactttggacctgtgagatgaatctatgtatcatttatgttgtgaatgattaatcctatggtatttcaagttggttttgctgatatcttgattttcattggcatagtggtcctggaatgactgctggtacagcaagtaaatcaggaaatgacagtgatggaatccctgcagatgatgaagattatcacaacaagagaagaaggcatcacagaggtcccctggaagaaactgaactagtttcagttgctcctaaagctcacccagtcagttcgcattatcgacgaattcaaactgacatacatcaaactctagccttagtgaagaagcttgatgaagagaagggtattgtgggaaacatcctgacaactggtgatcacacaaagtcaaatggtgacaaatcatatgctggatctacagggcctttagttattgtccggggcttatcaactgttaagggccttgatggttttgagctcctagacactctccttacttatttgtggcatgtccatggtattgattactatgggatgtctgagagtacaaatgcaaaaggtcttcgtcatgtgagagctgatacgaagaatgccaacatggacaaaagcagcgctgctgattgggagaagaaactggattatttctggcaagagagactgacaaacggcaaggatcctctagttgcattgactgccaaggataaaattgatgcatcagctgataaagttctagaatcttatgtcacaaaggttaaggatgataactacggatggacatacggctgtggagccaaaggatgtataaaagttttccatgctcctgactttgttctcaaacatctgaacctcaagcatcctgatttggtctccaaattgacttcaagagtccaagaggatatctatttccaaaattatatgaagtatgtatttagatctccaaatgcaaatgacaaattgttatttccgacatgtcaaaaggtaatgcttctgttgttgtttacttttgatgcagtgatccaaatgctccaggtggcacaccagttatgcagcaacaatcaccagtaagaaactatacactgtttagcttgttccttttcactgatatgcttaagaacattcccttcttgtttgtatggtggggtgagaaaagctataatactattcttaattaactctgaaactaaactaatttatctgaactgtttctcggtcttagaaggtttacattgcaccgattgttaatttcttccgcaatttccccctttgagatgcttattttcattttttagttgtttgtgcttatcataaaaacagtttgtttctttaggagtttgtgaaatgtttttccatgtcccatgtttgactaacagatcaatagaaattcaatccataatttgttgtgttcacctgtcactagtgaagctctatgttgtagatctttcaccttatttccacattaatgagtaatcgatgacaatattttacttcttgtaatatttatgtatgtgaagtctctgatgtttgatactgttcgttcttcatcataatccatgtaacttctctagtgttgaatgttcttaattttgcatttcaagtatatttgctgggggatattaaacgtgcagtgtatcacttgaaacttgaaagtgttgtgtattagttattgaaatcctaaacctgcagtataatccttatttataagcccgttctggtttgcaggagcagcaaggacctacaccttctgaactaacgcctggtgcttttggcgggcagggttccttcgttgaaatgcccactccaccagtactaatacctgtgcctggtgctgggtaggttaattatgttatgccagttagctaaacaattaagtactctacaaaaaggaaaaacaagtcagttatcaagtccaggcacaattctaactatggttgtcttggtttcagtccattgggtccatttgttcctgcacctccagaggtagtcatgcagatgatgcgaccagtgatgcccatgtatccgcctcgtccgcctaaccctcgtcgtctgcgaaggtcagtactgatcaactaaagtttgattaatttccccctaaagaacactaagcttaatactttgataaaaaaaaattgccgggtccgcggaaggacgccgacctactttgataaaatttggtatacgttaggaaatgaaaatccgttaacaacaacatggttagtttttgcactttcgaaatgatttgctaaatacgatcccaatgactatgcaatgctccttcctctcttgtccttgcctgtttctgcactggtttactgccctactatactttctactttgtgccagcttctcttgtgatcttgtcctattgcatttgattgtggaagcagaaaacatgatacacctttgtgtcgaacatatggatatgcttcgctgtagtttctgttgcctaactctctaaaatttaaattcatgatgttggatgcagctacaaagatcttgacgctcctgatgatgaagtcactctcgtggactacagaagtttgtagatgcgcgtttcgtgttaaccagcagccagcaggctaattcggtgatggttcctccagacagcgtaaaatttttctaacaactgatatgaaagcacgattacttcccgttgctgccacaatgaggagacggacgacggataggaaattttcgtcacgtctgacacttaagatgcgtgtcgcttgaacgatcaaccattctatcatacatacattgatctgcccctgtgttttctgatacttgaatgggcaacagaagttacgggattaacatgatctaatttgccactgtacatgtttgctgcaggatgatggaaaactagttattcttccctcttcttagacatgttcttttggatgcactccgtttaacaccctatatgaagcgagaaagacctctttcttcttttttttcctattaactatatatctgtctggtggataatggtttgcttaacacagaccgcgttacaatatatgttccctttgtagtttctattactactccctaacctttttttagagaatatcactccctactcagcctcgacgctttgagagttcgatcatgtgaaagacggaatacggttgtcgaacgaaaagggtaccattcaccgattaattagaatacgaacgattaattagaattatacgaaaatttaacgttcatgaatatatgtacaaattttataatattatatagttatttgaagatttagacatgtacaactatataaatcaaatatgttcatgttgttttataattaaaaagataagtaaaacattaactcttctaacactggatttatatatcacatagtttatatatcacatagtagtagaattggttgcattaaataagtagaatggaattcacttcacttgcttatgaagatgggcccacattggatgatgggcttttcttagttgtgatggaccttaggatatacggcctggattggagctgacgtgccttgggcccaactttctgcggtattgcagcccattaaaccttccttgttattttctgaacgttgatatatatgtggtcagagcaaaaaatgaggcaaaattaaccagttaaaaaatgtaggtcatggactgctgcagttaattctagtggtattcaaggtgtgttctgttgccatatcaacaatggacagaatgataggtatcttttatttagtcttttattaagtccggacacaagtacacaactgatctcatatttgcaagcaaacactaggaattcaaacagcctacagtatattaccataagagctatttatgcaatgagatagtctgtctggatcactgctgctaaaaaagatgaaggctccatgaagaattgtaggattacattaaacttggcctaatgttggcacttactcaggatgagggacaggtttcccttatgtccttgatcagtagttggaggaaacacaaactgcaggggcttaataactcatcagcgtgccgaagatgcagactccataggatctttcaattcattctgcagcaatgcacacatgaatatatacataagagagtacaacagttactggagtagtaaatggacatgcctcacctgaactgacatagatacaaccccagtactaacaaatcataccagatcatagtacaagttattgcttgctttggcaattgaacctaacacccccatatctgacttggctggaacaagtcaattttcagcaagaacaggagaagtgcggcattctggcctcttcaattattttacagtaacatcaggggaaaaaaagcattgcgatagggctctcagattgcataactatcatgtaactagagtatgttcaggtgtatatatgctccgttttgccatctcacagaacttctgcacactgagaaatccagggaccgatatgaaccagtaagctgccagtgattcttcaaactctagcttttcatataatacattgcatatcgaagctcagtttgtagcacattgaacatataaaataaatgtctacagcccacctaaaatgaaaccaatttttacatacactacacagctgattaaatatcaacatgtccccacagaagtttctaaatgaatggttatggtgatagggacaataacataataacagaagggaagacatttgataagtaggaaatgtcccaattacgcacattgtcccccaccatcttctgttcaccttcaccatgagaactatagaagagcctatgttcatatgccaccaatattctcatcacaggttcactattgggcctcacgtccagtgtggagcaatttgctgactggccgaaaatgaatcattgttacatatcccattattgcataaatagtagaaccaaccatttggttcttcaaccaaagctatttcactgtagaagcactccgataaaagcctgtcatcgcactggtaatcttgtcatttgtgtgcctgatttggaagctcccagccctcctgggccggggaatgaagagcgcactgagcatcttctccaaaccatcaactgtgtactttacatacttgctagcactaacatcctgctccaccagtggcccatagttctgcatataactccggtaagcaggaacaattgcctgaaccacaagaccacatgtcttctccctcaagtccttctctggtataacccatgcagattgtttacggaacatctcatcaaagctcgcattgaatgttttaaggcgctgcttcaccaggtcctttgccgtggcccggcccttggagaacaagattagcccctcccggttgagcagcggtgaaaccaccccccaactatccctcataaacaccgtcagatagtagtccttaaactgttcatgctcttgcagccacgcatcacccaaaagctcgcctaacctagtagccttcaagttcttaaagaaatgccagtgtgtgttcatcatgaagagatatgacagtgtcacattgtcatatgcctttgaccagacatcaaaattagcttcaagggccttgacgatgttaagcaccgcgttaacaagcatcttgtcactgaatgtctctttgcgccaactgcgatggatggtgagaacttgcgcaagcacaggcctgtacttctcactaaggaggcgattgcagtactcaaccacaaagctaactagtcgcggcacacccccatcaggtgggggaggcatgtgccgctgcagctccacctgcacaagcaactcctcaaagatctcaacagcaccatccactaacaacttcacaaggtcccttgtttggttctgaatctctacacacgccttctttccaccaaacaaccggttgaagtccaaccttagcttattcaaagaatcaaacacctccagcaaacgcaggagcttaatggggtccttcttcgcatcagcagccgcacgaccaaagctcaagaaatcaagaatgccggcgtgcgctgcaacatcagcgaagcacgctgatgcgtcatccttgcgctgcccaaacaccttgttgcagagctgtcgctcggactcaagaaggcagcgcaccacaaactccaaatgccgcccccacaactcaactccagggcccaacgcctgcgcgacgtcgaccgggtttcgcaagtaatcgaggccaagggcacggaggctggcactcaccacgcctccgcgggcatcagcatacacggacaaacaacggtcctgcctgccattggcaatgaggcggtcaagaatcaggctgagcttgtgaacggtcgcggccgggatgagagacggcgcggcagtagatgcagaggttgtgttcagctgctgcatcgcgagcgggagcggtgcagagtggtcggcgagaaggcggcggaactctgcctcgagcatgtccagagcggccgccaggaggccaccgtcgaggtcaccggaaggtttcttgagcccctcgagggtgacggcgaggtcggcgaggaaccttgggtcagcgaggtcatggtcgccgaggtactcgacgatgtccgcaagccactgcgcggcgaggccggagttatcggagaggaacctgagggcctcctcgaggcggccgagcacggcgaggtaacccgcgaggtccccggcgacggcgcccgcggcgaggagcggcggctcgaggccgtgcacggcgtcgaacaccttgagcacggccgcggcggggccgacggcgcggtcgatgtggggccccgccgcggccagctcggcccgcggcgcacggatcgggcgcacggcggcctccagcgccggcagcgcgagctggatctcctccacccgcggccccgcccgcgccagcgcctgccccagcgcccgcgacttctccaccccggcacgcagcgaccgcgccgccgccgccacgctctccatctcccccgcgccgccgccgctacaggctacagagcgagatggcggcaaccccgccgccgccgccggagaccgcaatgtagacgaggagtcctcctccggtcctcccctttctctctctctcctccacgcggcttcgagttcgtcttggtgggaggagagaggtttggggggtttaggttgaggagaaggagaaggtggtagaaagagaagagagagaaagaagccaaggagaggaaggggaaaggcatgtttgagaatggatggacgcatagttttctttttcttttttaacaactcgtagtattaatatgtgttatatcgttaatttattttaatgaattatatattactttattttttttaaataagtttattttttacacatcccacacatactaataaaaataaaatatatatataatttacctactttatcaaatcgcaatataattatttcacaattatctatttttaatgtaattattctctattttcataaactctaatacaacaattacttaaaggggcaattgtttgagtacaaataagaggggaaaatgggcttgttatgagacagagagagtagagaacggggagtattatttatgatactgtattattttcttgacaacagaatgtaagcatactgcatgctcaacaaatgaagaacagaattagctcatagtcttcataaaacatctctattagtaaaaacacaatgagtccatttgcaattaacaggtctatcaattatataattttatatttatcacttattttgaccggtttatcagttatgattaaaacaagtatatatagtcatggatcatggatgtagcattgtttgaaccacggtagctggagtctacttgcatatacttctacgtccggcatgtaacccacttgcgaattcgtagcagtattttagtgctatttacatggtaatcatacacacattattatatttctctttcgaataaaaagaagcatgtcagtagctggatcttgatcttacatgaatcatgaccaatattgaaacattgtcaaaagggaaaatatattcatatgatcattacatgtggaatgccagaatatatattggatccaaacccaatgggcaatggcccaggcacgtgccccttgcagcactgctacaaggtgacaaatcacaacgggctcaagaggcaaacattccagtaggacccctttttttttcttctcactttctaccggactagcacatgcgtatcatctgcctgaagatttctgaattcgtaacatgaaaaaagtttggactttggaaccatatgtaataatcaagttcacattatttgtttaaaaaattcaatccctaaagatttgatgccagattgaaacgatgtttataatagtatctaatcaaagttgtagtttggctctttgtaatctggcatactcactccagtttgacaggcttggatggccttttgctcatgtgaaatccggccacaatttgcatggattacggctaatttttgtcaaaagctgtggttagggaccaacaagattagtgggccgcatgtttcggcccagttaaactaaaattgcccttttggtgggctttttcctgggccttttttctttctgaatttctgaacatgaaactgaactttctcttgttctgctacactcatcacctctgatattccttttcttttctttcttcttcttttgtcttttggaatattttcatcatctctttctctttttttgccaactcatcagattttgtcacagtatgcaaaaggcaaaagaaaaaaaaagaagataaaaagaaaacattttgcggtacagagagaatacatcttgattgatggtcctgaagatcgcctagtacacgagccacattcctcttggaagaaactgctgcgagaatctcaccttttgtacaacctttttagagtccatgaacactatctagcagctggcacacactgatatgtgctcagaatcaagtcccatgctgtctcaacaaacgacataacctactgttcatagactaagtcacgagtatttttcttgtacccaactattcgtgacacctgtttggcaaaatcatgcgttccaactcagggtccgttcagatctatttggaacgttaaatggcaaaagttttggtggcaaaagatttggcatggagttgatgtttagatgcattttaaagttttgtcattttagcacttgagagagagagcgtggtcctggagcattttttggaaaatttgctactctagactagcaaatgacaaataccaaattgccaacttttactactcgtgtttagatccaaaataacaaaaagtacaatcccctaaccctgtagaataaaatggcagactaccttgcaaagaaatctagaaataccaatcttcgagttactacccaaaccatgtatgtttgtcaaaatatatctcatatatgtcatcaaagatgctgtcatgttaaggaagctctcaactcagctctagtagctgatgatgtaaacctaatccatgtcttttaatgtttaatatattatgttcttaaaaaaaaataaccctgtagttctacggccgcgtttaaaccaaaggttcgactgaattgatttatcagacacgaaacgagacaaatcattagcaagtattaattattaagtatcactataaaatttttttaaaaatatttatttgattttttttaaaaaacttatgtatatatatttatgaaaaacgagtaagtagtccatccaagtagttgatataaactcagccgtacatgtgcatgtgtttttccaattaaccaatttggatttatttattttttggaattgaattaactcaccgaaatatatattcagtggtggccaaaccaactattggataagtttgaccgtcaaccaggcttattgttattagccaatgacaaatgctattaaattgtttaggctcaatgtcgacgccgctagctagcttcatcactgtatatattgaccaattgttatttgaaaatagacatacacaaataagtttttttcttcattccattaataatattcagagttaggttttacaaggagctgcagccaaaaaccatgggagattcatccactgattttgcaatgatgttttaaagatgacttgtccatcttatttttctttctttctttctattttttattttagagagcaacctgtccaacttccactttgcagcatggaggaggacatggcaatggagaagaaagaattgagaaacctcacctgatggatacaagggttgaaaggtgtttggtctcttctttccacgtcacacgtcttcatccctctctgcgtcaacttggcactatgaatagaaaacgagatgtcacatatctctcaccatgtctaccactagagctacagttggtgctcaaaaaacaaaagccattattagagtttgctacttttttgctggtctttctcatctttagcttaaacgagtactactactttttttttaattagctgacacgtaatgatgctacatgtgtacatgttaataaagcgtgtacaattaattaactaattactaaacaatatctgttgcacaaatacatagtaggatgtgtttgacatgagagaaaaggagaaaattgagaagatacgtaaaacaagatgagtcattagcatatgattaaatattatttaagcttgaaaatatgattaagttactttaatataatttttaaagcaaattttctatacattttttttaaaaaaatacgcattgtttaaatgggaagcgtgcaagtgaaaaagagagatttcttttctctttatcctcctaaatcatccggttattggttattaaacgggaaacctctattaaggggattgctattcattgaaggtttttctctttcttatcttcaagtactcttgattaattagctgacacgtaatgatgttgtatgtaagcaaagtgtgcaattaactaataaaaaaagagggtttattatataatatctaaattatctagctgttcgttattgaacgggaaacatctattaaatagatggttattcatcgtataaaggtttcgctttttttatcttgaagtacttttggttaaacagctgccatgttatgatgttacatgtgttcattttgagtaaagtgtaaaattaacttattaagcagtaggaattaataggtccattaaacaacatctaaagcattcaacacacatgattactgaaatgaaacctttattaaagccatcctcaatatggtgcttacacgagagctggcaagaaaaaggtatttctttagccacattgatgattcgaccatacgttaaatcattagcagtcagtgctttatcaattatggatatctattggtatatatgcttagggcaacaccaatttatatagctaaaataatccatatagatgggacccacatttgtggactttaactattgcaacattcacaatgtatataggtagtaagtagtaggaggaggagagaggaaatagagacaaatgacatattttattctatatgggcagcccatatgcttatggatgacttttgctatttctctcctatggactacttttacaatgtggttaggtagctgaatgtattattttattgactatggactggttttaaagtacattgtggatgcccttattgatatatctatgtctaatggtagcatattctaattcatatatctgacactaatttctcatctaaaacacccgtttaaattgtttagttaagacagcttaatggcgtggcaactttttttttcttcttctaaacacacacggttaatcattttgtattggatgtgtctaagaagactgctagtcatagaagggttatcagatataacccactattgccaatgagtgacctttctaatttgattaaaaaagaaatcgttgtatgaataacaaaatacaattgagtgttcacaaaggtctcatcaatcaaaacatgctgcaaaagctaaaccaattaccaccaagcaataagacacccaaatccaattggaattgaccaaaccaagagttcatcgtactgtccacaaacttattaaaaaagcacacaccaaaatgagcaatgttagttgctatagtagattaatgggagtgtttgagaggagagaaaagaagaaaactgagaagacacccaaaacgagataaaccattaggatatgattaattaaattaattatttaaacttaaaataagattaatatgatttttaaaaataacttttctatataaaatttttacaaacaaaacaccgtttagtagttcgagaaccacgcatatagaaaatgaggtctcccgatcaacttgcaagaaacaaagattattacgtcatcgtcccaaattagttgtctttctaaaatactgtaaaatttatctcaaaatagttgccactcttatgtatactatgatagttgtatcaatctattctcatttaaatttctttttattttaatcatatctcatctttctgcccatgtaaataaggaacattataggcttttattcttatattttaatatatgaatttgttgacgggttatatacatatagatggtatggaggcggaatcaggatatatgatctacgagacgccggataactgattagttagtgtgagacggatgaagcagcaggtgagagagccaaaaaccagagagaaagcaagcaaaccacagaccaaaaaaacaaaaaacaaaaaaagccaacggcgcaatgcaaataaacggaggtgtacacgcaaactgcaaacgaagcctatggccggtgaccatccatccatccgttgacccggtctcctccccgccacgtcaccacccgccgatcattcccatccactcctcttcttcctcctcctcctctctctctctctacctcgccatcgctctcctcctcctcctccatccattcccctcctcctcctcctcctcccatgcatgggaggccgtcgaggccattagcttcctcctcgtcgtcgtcgtcgtcccgcgtcttctccttcttcttggcgccgcgggttttcttgttcttggtggtggtggtggtcgtcgtcttcttgccgggtcggtcgtcttgctggtggctggagggcacggaggagttggaggaggagatggggtttgccggggactgctcgccggtcagcggtggcgggctcaggtgcgttccttcgctcgatcttgggctttcttgacttgaccctcttttgtgttgccgtggtttcgtgttagggggaagatccaagaggaggaggaggaggaggagaaggatgacaagtttttcatggcgcggtcaggggctttgtgcttgatttgattggcggctaactatcgagtagtgattcttgaatcagaggctaggacatgaggtttcagtggcggattttgaattagatctgcccgattttgctctgaattagcttagcctaatcgggttccagctcctggctggtgtgaggatgtggccatgattttgaatttgaggagtgtttgaaaacgaaaagtctaatcctttgtaagggcatatggtagaggaattaacctttttcttgtttgatgtgtctgtgtgtagcaactgatttttatggagtgttattagttgtagggatctgtagtctgatctgatttggtaggagctccaaaaaaaaaaaaacattcatgaaataacatgtgagaaattgatttatgcaaacaagttctttttttgtccatttagtatgtagtaacagttttgcgccatcggcataaattttcctgcaaatattatcctattaatgtaactgagaacatacagtactgctagctaataaagataacacatttgattgtcacacgaaattaagtgcactggagtccatgattttagattttgcgtatgactaattaataaatgttccccttttctgttgacagtgaaaacggcaagttcagttatgggtatgcaagtgctcctgggaaaagggcttcaatggaggatttctacgagacgagaatcgatggtgttgatggagagaccattggattatttggcgtattcgacggtactgtacagttccacgagaaatattattaattgtttgggttttggtatgtcaggacatccttgatcaacttacttggttgtacatataggccatggcggagctcgagcggctgaatatgtcaagcagcaccttttcagcaatttaattaagcatccaaagttcatcagtgatatcaagtccgctatcggtatggcattaataattcatgcattacggagcaaaaataattgtagccaacctaaaaggtggttgtgatttctctgtacttttcttgcagctgaaacgtacaaccatacagattcagaatttctgaaagccgaaagtagtcacactagggatgctggctcaactgcctcaacagctattcttgtaggcgatcgcttgctggttgctaatgttggagattctagagcagttgtttgtagaggcggggatggtaagtcactaaatctaatgtgtgtaacatacttcagttagtgtccagtgttttcctctatgtccaatttcagcaggatgcttgagaaggcatttgctgtctttcttccaatttccatggttggggtacatggcagttcaaattatctgaataacaggatttcatattagtattatttaacacatgttaatcaatcataatatttctcctgtccacccttgcagcaattgcagtttcaagggatcacaaacccgaccagtcagatgagagacaaagaattgaggacgctgggggcttcgtgatgtgggctggtaatttcatgattcctttgaaattatctattttgctttgtacttgtaatgatcattggttctttctaacggttgaacgactttgcagggacgtggcgtgttggtggtgttcttgctgtttctcgagcatttggtgataagctattgaagcagtatgtagttgctgatccagagatcaaggtttgacttaatttgtttgcttagctctcaactaaagccttctatctgcaaaataatattcatcatcgtaattggcattcccatgcatgttactctaaagtagtccaccaatgaactctactttctacctaagttcttcattgcttttatgcaagaaagcaaacaatgagcctgctccatcaacatatcatttatctttccatttggtaaaagaaatgcatcttgttttatttacaggaggagattgtcgatagctcccttgagttcctcatccttgctagcgatggactttgggatgttgtaagtaacaaggtaacaacagaaatttcttgagtctccttcacccgcttgtatgttgccattggcgccttatatatgttactcaatacatgaaacccaaattctatttccaggaagctgttgacatggtgaggcctattcaggatcccgaacaggcagcgaagaggcttctccaggaggcgtaccaaaggggtagcgccgataacatcaccgttgttattgtccgctttttggagggaacaacgactggtggtggaccaagtagggaggccgccagcgaccaaaactcatagtttctcccaggcagcagcatggcttgttcctgtctgtcatatctgatgctcaaggtagacgattacagtggcggcaccacccaccatgctgccaagaactgacccggcccgaatttcgtcctcgctttcatgctcctggctgaccttaggtggtgatggtggtggtaatgtaggagcagaatggcgatggggccagtgttgttacatatgatatgatcgaaggtgtatcgtgtcttatatataactttgcaatgtagattctatgcttgtgttccatgctaggtctttttttttcttttttagcatcaaatgcatgtaatagaagtaaatttaaacgatttgaacgaagttatacactgcagtatgtaacgaaatctttgcgtttgtatttctgatgccatgagcattatgatttctcataagctccgagggtcaaaactccaaaatctgtctggttttgtggttatgcatcaggaggaaagcttgtatcaatagctctctttgcttgtggtcattgtggatttgtagggaaggaaaataagaaaaaagaaaactcccgattaggggtgaatacggtcaccgaccgagtgttgtttccgtaaaagggtaccattttggaccgtacccttttttgctatttataaattttgtttttctaatttctttttacatcgtattaatgttgacattgaatatatggtcaattaacggtcgatcgagcatcgtttctgaagataagctattgattccgaccatttccgatcattttcacgctactcccgaatgtctcgtggttccatgcacaaaaacatattcgatttttctgtacatgaaagattttctgtacaaaaacatattcgatttgacagtttgacacacaccacgatttattattatgcataaagagacagattagcgataaattaccgaccttgttaagatcgtactaaagctacaccagcagcgtgaatataaccataaacacgaggatttaaacctgataggtaaaatggaggcaatcgtcttgctcaagcgctccatgtattcaaaatggctgcagcgatgcagaaatgagagggaaaattagagcagagcagagcaaatcagctgctcctgtctctcagttaattttgtaccaggcatgcacagtaagtagtgttgattgattgatacagcggttttaaactttgtttttttatttcctgatttgaaattgaacaagagtagagagcttgagaacaaacctgtttgtgtaattctatcccagatcggcaaggaactccctgcatccagtggaaaaacctagcaaaagactgccctaactctgcatcaagtagcatcggttacaagcagaatatgatgtttactaccaggacagacattacttactccagattaatgataataaaattcagaatacatgcatggtaaattggtaacagcatgagaaccaatgctggaaaacggattaaccatacaagaaagatgacagttaggatcactggacaatctaacaacacattgagtgcagcatgtgtcctgttctgctagtagaagactcatagtagcatgggtgcagtatttagttatagaatgaaagacccaggatatctaacatgtatattgcatgccagacataagtcactaatacataagtaacatcatcatgattaataaataagtaacataagtcactaagcatgacatttgataaagacagggatgttgaataaacagtggcagaaagtaattcgacgaagatagcaatgttgagacagtttcagttaactttgcagctcactaggcctgtactgaaatgaaattgagttcagcaagaaaataccttgtgcttgaactgaaccaagattcattgtgaataaatctttcaagtgcacttgaagaagaaggccaagcttccccggcaaagagtggttgaagaaacccagaatcttctgactcaatgttcagcttaacaccgcaattaccagcaaatgccatttcaagaacactcgtattaagacctccatcactaagcaattcctaaacggcctcaaaacctttctttaagatatcctaggtcaggtcaatgcgcagcaaaactccatccttgccaagcttcaaatcaagagttactgtaaatgttttttttcaaacaaccaaacagattggttggtgttatatttatagaaggggttaagttacacagccgaagactggatgaaaaggaaaaaaaactgtacaattctgacggcaaacaagcttgcacgtcagacctttctactcctcatggcaacaatcttgcaaacaagctttgcaccggccaagctccaatagcctaactcatcttggatgcaattggttatttgataagttgttgtcttttttcctctgaagattctcacattctcttctttccatatctcctaggcaatgagcaaaaagactgatttgagcgctttgtgttttgttgtcttcaggttgctagtcccttgcgtctactaatccaacaggtctttgctagcactccacttctggatgatgtgcccttgccactccaccattatatcatggcaagtcacataagcactgatgaccagatttccagggccctgacccaattttcacataaattttttctttttttcctcgtatattccctcaaattttcacatgttttttttattccacctattcttcgtcatttttcccattcccccttatttttctttttttcttttcttttttccttttcattcatttttagcattttcttggccttatatttcaaattttttggaccaaacatgctaatgggcctatgctggcccatacaccacatttgggctcatggcctccttggattatgtttcggcctaggtctcaacacgtgggtcggcacgacacggtccgctacagaaaaccgcgctattacaaagtcagtgccatgctggtccaggctgcccgtttggacacctatagtcttatcttccctctcacaacgccgtcggagcaatatgccaaaatggacttggccctgtgccgtcgtcaagatgcagccatgccgatgcaggtctccatttcatgatttcatctccatcgatccacacgcgcggcgcagccagggatgtgctcactttgttcgtaagcaataaagatggggattaagtaaagccatgtaaaacgataaaattattagtaattgattatttgttgggatgtaattattagtacaaacttaaaagctgatttatttgatattttagaacaatttttatatgaaaacatttttataagaaacgtattgtttagcagctttcagcttgaaaaacgtgttaacgagagtgggagtagattctgtattttaattagaaacgaaaggatatccagctcctctgggttttgacgaaccgtaccatgaacaatccatggataatatatccagctgatcaacacaactacttttggtcaattcctccatctcactctcgctcctttttttttttcttgtcttggtctcttttttttttcccatctacataattgcatatgtacatatgctttgacaagatcatacgtacggtcggtcgatgacgtcgtggtcagacaaaatatgtcaccaaatgtgaccgtgacacagctgacaacatcattttatacaagagcagaaacaatgtactagtactacgcttctgatgaattgcgagaccaaatattttgtttgtttttgcatgatcatcacttgtcatgcgtacgtaccttcgatctattttagtgagtgttcaatgaaccatacatattagtattgtttttgttaattaagtatctcacctacttagatcctcttatatatgttctctcttgatctcctctgatgttacctataaatagctactactactatttctctttttgagagaccaaattagctagtagctacttcttgatgtttttttagatgtcttgtatgttaattgccttctaattaaacgtcaaactccaccatatacaaaatccttttacactttcactttgtggattagtagaaattagcacctatacatatatatactacatatgataagtgaacatggagcatgagtcaaaaagtgcaaaatctctgaccttatctaagccgcttttcttcagaaggacctttcattagccgaatcagctctggattattgatcgttagctgctttaacttcagcatcactgaaaaagaaagaaattaacaaagagagattaaaaccacagtatatgtgtggttggttcgtgacagcttccgggcttttgacgccatctaacagctgacaatttcaagaaccatataaagtctgcaccttcttcatatcatcgaagcaaatcaagactaatcgatctctgcatgcaatcatcgtacaatcaatcgattaattacttccacgatattgacgaaacaaacgtatttcttcagctagccatggaacaggtctttttaaaatattactcctaatcaatttgcagtatacatctaaaatagagtggaatgggtacaaaagcagctctagacctgatcttctgctacaatttgctgcagtgaagtcttttttttttcacatcgtacgtactagctaattaattacttaactagctagatcacctgaaacagtcacttgatcaatcttgttttagactttttagatgactttgtcagttgagctactgatgatttagaacacagtaagagtttggataattaaaacgaatacatgcacataaatataatattagcatcgatcttggacgttatcaacgcccctatggcgtatttagtatttactgctttagggatcatatttcaagaacatggaagggtgtttatttttgtattgacatatttattaattattttaatatttaaaaatagtgacaggatatataataacatcatcgtgacgtgattgctaatatgtagacccatggacaatgggtctcacatgtcagtagtgacgatgctgtggtgtacagtttacgcgaaaattctttttctttcaagtatgtagatattttatcgtgttatttacttatttttcctcgtctcttgaaagatctgtaaagccctttttttacaccttttgtgaaaaagcaatatgtctccttttgctaacaaaaattgctgtccgatcatggcttttaggatttcatgtctgctggttgggtggactacacaattttcagcaactacggcacataatatccacaacaccagcgtcgacgaatttcgaaacccaatcataatatcgcatgacggtcatatccacgaatatggtgtcaaaatcaagagatctttgttcatctagtttcaagaaaaaacatatctcttttacatggccctagacccattcagcgcgcattattgtttacttctccaatggggtccattaatcactccatttcacatgagtaagccatgaaaatgaaggcaaagaaaattttaaccaccatatatatatttagtcagattattctccctgcaagttatctcagctagattttccttcaacaacctatgttgttagctgtaatatttgccaaagacacgtaatcccttattgcaacaaccaagcagcatactggactcatgcactactaatcatgctctaatttcaaaaaaaaatactaatcatgctcttggaatataattaagcttaattaattgtttgtctttgctatgcggctgcttgctgtctccgacattgaccatgctatgatcaacttacacacgtgtgcgtgcgcgcacacatcactacatttttttcccggtcgattttccgactctcgcataattttttaaagatatttttgcgtgatatgttggacttctagacttaaaaaattttaaatatatagtggcgtaatacaacaaatgtattatattattcctagctatttgaaatcaagtcagcgttattaacttacatatatgaaacctgtgacacaaaatatctaagtcgcgattttggctataactagtaaggctgcttatatataggaaaatatcatgtgaaaataaaccaagtgttggaaactcgtaaaaatcatacataaaagttttataaattcataaaaaattactagagataggtgtagatatgaaatatattctcaccaaatatcaattccaaactcaacttcatttgagagaaacaaaagtaacaaattttaggtgaatagtctcatattactcaccctaaatttgtcctttttgttactcccaaataaaattaagtttgaacttgagatttggtgataatgtatatcatatctacacctaactatctccaataattttgtttcataaatttgcaaaagttttaggtaagattttcaagagttttcaatactactaattagctagttttcaccgaatatatactcgtttgtatgttccaaatcgtacaagttagtcaaaccgtactaaatatgtctgttcaaaatgttggactagattgtctaattaagtcatttttttcttaagtagtggtaaagtctagggatgacatgcatgaacgaccgtaccaattttccacgtgtacatactgcctccttgctatgcatatatgctgcagcaagacagcaaattaagctaaggttaattgccaaattaattatattggttatttggtctcctacttgaccaggatattagtaatgccaagatcgtacgtgcaagtaagcggatttttttactagtataattttctcacgtttgatcaattattagcctacgaccagatacttaggtacatctgactaattaattaacagtggcacgtacatatacgtaccatatatcacctggtgtttattgcttaatatatctctgtcttgacttgtaccataacttcgaaacacatgaaatataattaataattcgtctgtaaaggatcgatgtaccaggccagcattgcgtcccgatggaccccaaatcaaactgtaacaaccggtcaattatcgattttcgactggttatttcatttacatggcggtcagaacgtcagattatcccttactcccgagccccattgagacaaagtatttatagaataattttgtagaatataaattttataggatttttttctatctagataacactttaaaatataggattatacccaatttaatttgttgacaaaataagacggatggtcaaacattaaaaaaaaaaccataactgcatttaaaatgggatggatgaagtacatcctttacagatgaattattaattatatttatgattattgactttttaacagagttttctgacttaatttgagaaacatcaatccgtacttgcatacgtacatcagtacatgcatgtacgtatagcagcctagcgggattgacccgaaattgaggtgcttggtgagctcaagtagcatgcgtactggagtgttgactacgtgattatactattcatcaccagtgatttttttaattatatatttagtttagtatgaacgaaattaagttgtgtggtatatctatgatgcacaatactttgatgatatggaatgtttcagtttatattttaaaaagattcaagttcaaagataaatagtggaaactacatatctagagataggtggtagctagatagttaattgcatttcaataaaactccatcgaaccctgttagagcatggccaactgcaatccaaaactgtgttccattcaaatttcattttaatctctaaggattcaaacatatacttctctccgggagatatcctaaacttaactttctataataataataataataataataataataataataataataataataataataataataataataataataataataataataataataataataataataataataataataacgccagttatgttttcaaaattaaagttgtgtatatataatcacaattcgttcatccacatgcaattaaattgacggttaatttgaacatatattggactgcacagcgttaattaattcagtcgttcgatcgagttcgttgatcaatttgcagcacgcagtctgcgaatgcaaacacgtaagcaaacatggacatatttggtcagttgatcaatcgatcgaccatatatatatatcgttttcaatcaacgtgcacgtgctacgcagccctcgttgattaattatcactcctaataactgtataattttgggcgattattaacgttaatccctacctgataatcacacgtacacacattgatttgattgtcagttaattataattagtccgtagctagggcgacgtcttccaaccccaccaacagtaaacaccctgctagccacggtgattttatatattaattatttcacattttcactgcgtactgtaaagtatagtcaaaagtattttaaacttggactaataatatggctacaatttgtgctaaaaaatatatggttacaattaattggtgttccacatatggaagagtaattctattttaacatatataatagaaattatattgttactctagtttagcggtcttaactcaaaaattgtatttctttataaataaaagtacatcgtagacctgtacatataccagttttatttttcaaaacaggagaagcaattcagcaataatgttgtgtacttgacgcttgaaatgtttattagccgttgtaaaattaaataaaacttaaactgttgcgaggatatatataattttctataaaaaaatactattatgctcataataattactagtgcttagttccactaggttgtaaagttagtcagacaacatcttactacacaccatgcaagaagatgtactcccttcatttcaaaatattttgtttctttacacgacaaagctttggccaactattgctctactatactattattatgatataattaacatgaaatttaaggtactcactccttccactctaaaataagttcatctttggcattgggtattcaaaataaggtggaggaaaaaaaactaaaatgttgttcatattagcgaaagtagtattgacatgtgggtaggtaaggagtagataaaagttagcgaaggaacaaaacttattgatttatgatttgtgaatcaagagtaaggaaggagataataggggaacttattctaaaagaaagggtataggcatagagcctagaaataaaattattttaggactgaggagtagttataattattttttaataacacaaataatatcttgatagaatatatataatatttatcaattatcagcgccttttctaagaaaacaaaatacatcttctattttgggacggagggccatattgttattccctccatcaaaaaaatattaagcatatttttttagttttttaaataatatgatcatatttatattatctaagacttaaataaatatattatcttttcgttttgtaatgctagattaaatccttgaacagaccataccaactaatccatatgttccatattgatcatcatattaattttttcaccaaaattaaggaaaacttaaaaacttaacttccttgtattttatctaatgtgcgtatgtggtagagaaaattaaaaaaaagcttttaactccccatgcacaagaaatatgtgctttattgtactacccggaatgcttgcatatatgtactccctccagttttattttaattgacgtttttggacaatgacacggtctacaatatatatctttaaccttatttttctattataatatatacaataaataaatgcatgtttactttaattatagtgttttgaaagacaaatctatatacgttgttctagtttctttaaactaaatatttttaaagttatcgatggtcaaagttataaaagtttgacctcaaccttatccaaaacgtgaattattatagaaccggagggagtatagatgtagtaacattgcacatcaaacgaaggggccatggatcaaggttatatggtgatcaatttggaatttttgacttttcattgtatgatgattaatatgaaaacgataaaaatatcttaatactcgttggtggcatacatacattgctagtttttttttattgatctttgatgacaaaacaaatacgtatgacactttagcatcttgtttcataaaaaactaacctttttggtactagattgatttttttatgggctggaggggtacacttttggatagagggagggagtgagcaaacatgagccaacagttagcgatgttgttggtgtgcagggagcgagcaaacatgagccaacgcattgcgaaagccaataaaattggtcagtttcaaattcattaattgtcacccaagtttagctagcatatctagatcttgaccaaaatcagacttgtctacacagtcctacacctgtggctgtgccgcttcggtttcctgtctcccagtccaaccaccccattaatccacctaattaaccaaattaattactgataatcactgctagtattaccgcataaacctccactgttaagttacttaacctaatttcccctttaatccacacacgtaaccgcaagcgaccacgtcgatccatcgattggcttcgcgcgccatataaatttgcttcaattcaccggagaagccatcaaaccaaccaccattggcgccatgtcgagctcgagcttgacgacgaccagcagcatggactccgtcgtcgacggcggcctcgacacgcgcctctctctcgccgtcggctgctgcccgccgcggaggaggccggtgttgctgttcggtgaggtgctcccgtcgccggagaagaaggtggcggcggcggcggtggtggctgctgggaagcgaggccgagagcagaggggtgaggctgaggctgaagctacgacgacgaggcagcggcggagctgcaagaagggcaggagggggaggggagacgacgatgacgacgacggtgatcgccggagcccgagcggcggcggcggtgacgaggaaggcgcgagcaggaagaagctccggctcaccggcgagcaggccacgcttctcgaggacagcttccgcgcccacaacatcctctcccatgtaagtcacaaaattactccaaatccacgcgatccaaattcaatatattcatacatgcagattttatcttagcttttattataaaaaccttttcaagttcgtaataactaaaactcaattaatcttgcgctaatagttttctcattttgtatgtgtgctgactttatcttcattttaatctatttcaaacgccaccatagaacattagaacagacaaattattgcacatggtttcgtgaaaaggatgtttgtttcatccgaaattttgatcagaaatgtgattgaattttggaatcaaattcaaacaggcggagaagcaggagctggcggggaagctggggctgagcgcgaggcaggtggaggtgtggttccagaacaggagggcgaggacgaagctgaagcagacggaggccgactgcgacctgctccgccgctggtgcgaccacctcgccgccgacaacgcccgcctccgccgcgacctcgccgagctgcgccgctcctcctcctcgccgccggtgtccggcctcgccgtggccacgcccgtcgtctgcccctcctgcgcccacgacgacaagcgccgcctcgccttcgccaccgccgccgccgccgccggcgacatggccagtaactgatcgagctgggctcctgcttgccggccatcacaaacactgtttaattaattaattagacacgaacaattatttatattaaggttgattttgctagtactagtttagctagctagctagctagctaccacgggcttaataattcgtttggattattgggaaaattttatactctttatcaattaggaacatgattaattttgcatttttactgaccaatacatatgtttcgtgtgtgtgtgtgtctacatacatacatacatacatacatacatacatatatatatatatatatatatatatatatatatatatatatatatatatatatatgtatgtatgtatgtatgtatgtatgtatgtatgtatgtatgtatgtatgtatgtatgtatgtatgtatgtatgtatgtatgcatgtatatatacacacatacatatttggtacaatcagtaagttgatttttctgtcactcatgtgcttgattattgtttctatattttttttcatgcgaatctcatatttaattccatgaagagatgcatcttctctgaattcgtttagatcggattgaacagaaatggctaggtgaaagatcacaattttttttatcagtcgcaacagtttcatattcagagtctcaggtggtgtttggatcgagggacttaactttagtccatgtatttagacactaatttagagtattaaatatagactacttataaaactaattacataaatgaaagctaattcacgagacaaattttttaagcctaattaatctataattagagaatgtttactgtagcatcacataagctaatcatggattaaataggctcaatagattcgttttgtgaattagtccaagattatagatgggttttattaatagtctacgtttaatacttataattagtgtccaaatatctgatgtaataggaacttaaaagttttagtcacatctaaacaggtccgaagactcgttaggaaatagcacatgcggaggatttcttcaactcggtagcctttgcattcacttccatcagttaaaccaagcatgttataagccaaaatggagaaaaataattatatgttatctgttactacaaacattattaataatcaataaccactaattaaatgactaggagaggagggcaaatacactgcatacaagcatacaattcacaagcttagtatagatatgtttgggccattttggaggccatgtgtatggttgaacagaaagcccaaacaacaccagctaggccctatttgcacaaaaacagcagtaatgattatgaattcaaaaaccaaaacaaaagaaaatgtttcaaaaaccttcaggaggcaaaattcccaaacctccatgaatcaaacatccatcccctgctctccatgtgctactctgaaataacatttctcagctacccaaaaaaaatcatgcgttccaaatattgtttgtactgcataaaagatgaaatccttccaacttttcaagagagattggatggaacaagcaagtgaaacaagtgatggattggatgctctgtttttcatccaaccaactgatgaagaatccttcctcttgtggagtcagaacaaacaccctcgcagcgaaaaggcgatggagaatctgatcgaatcagacacagttcttgttattggccctgaccagaaaacaaaagcaagaaaccaaactacacggacagaatatccaaagctgaagtgatcatgatcatgcatgaatcatactggaggacataaaacagaaatctttttcaccagcaatatatacatatatatatgatatagtagcattgtggtagcttcagatgatcattcatggtgagcaaaacaagagaagaaagccgaggattgttactgataatcatactatgtgtcagctactgctaattagtacttcccccgctctaaaatataagcatttatgcgtgtttttcaaaatgaataggcggagaaatgttcggaaatattttaaaaaacacggagaaatgcttatattttgaaatgcgggtattacttactactgatgaagtgtcagtaattactgctaatataatatgcagcagtgatgcaagagattgatagagattaggaaatggtcgtcgtcgtctttgatgttcttctcctttcttggccgccatggctggcaatggcaatggcgtgagagctcgctttgatttggctgtacacgcgccgcgcgctcatcggttgtgaagagggttggagccggtggggacgaccctctcgtcggcggcggcggcggcgggcggcgaccacccgcggcccgcggcggcggggccggtggcgccgcctctactgctcctctgcttcttgcaccgggaggcggcggcggcggcggcgtcgaaggcggcggtggaggaggcgacgacgacgcggcctccaccggtgtgcgccatgccgccgccgccgataggcacgccgcgcgcggcggcggcggcgagcagcacgagcgccaggcacgccgccgggagggagtacttccaccgccgccgccacctcatggcacggccacgtcgccacatcgcgctcgcgccaatgccaagccggggcaagcaagcgcacgcgcgaacgacagacgccggcggcgccggcggcgagaggcgagccggcaacggcgtggctccgacgagcttgacgcgtagcgaagtagcgaagctgcagaaggagaggaaacgagagaagaagagaagagacaactttggcttgcaaaacccgtttatatggagtacctctttgtcacaatatttggcgcttaaaataatatactcgtccaaacttttaaaattttgactaattagagagtagtgcatgatttgatttatttttaaggtgggcgaataataaattatgtttgttacttgagtaaatttcacgaaactacatagttaaaacgtcgtattacaaaactacagatttaatacaagacttttcaaaaaaaactacagatttaaggccaagcataaaaaagatagatttgatactcgaattatcacaaaactacatatgttacggtgtaaatttctaccactactattttgtcagagttataaatgttgtagttttgtagttaacttggtgcaaaacatatagttttgtgatatttttattactaaaaatgtaattttatgatactccatcttaaatatgtagtttttcgataaatttggtcctaaatatgtagttttgtgatacatcgtcttaaatatttatttttatgttacatcgtgttaaaatctatagttttgtgatagcttgagtacatgtagttttgtgaattttactcttgttattttgtattagtgaaatgtctgtacgttagatatttgtttcgtgaaataatatagtaccacatgtgacaaactaacattaagtcatgacatctcttgaattagttttttagaaaaaaaaacattagccctcctttggaatagagaaattttgtaaacaaatttgaggaaatgaaggtgtgaaaatattcatgtgttcaaaatgaacccttatgccctgtttggctaatgggttaaggaaatgattttccacccaccaaagagtgtgtatttaaatcctagccatccattatccctctcttatttcatcctaacccttcacccattttcctacctcaattccactcctctccccattatccaaacacactgttaatattgactattttgttgataccaaatgtggagtgtatggaccatcctactaagaaaaagatgatgggaaatttaggcccaatatgtaattttctgaatattggaatccattacacttgaccaataaaagcattgattttgtgatcagagagctagaacaggaggtgcataaaagagggggtcaaagagggactcctaggattaacagtaggaaaagctgcaaggccagccccatccctttgatgcagcactgccaccaaaccacattgatgagccttcaatcacctatatgcctcagagaacactgagaagactagagagaaaaccacagcatatggggagagacctacttaaagcaaaggtgtagaccattgaggcccttgtgatggaatggaatggaatggaaatgtacatcatgggttgtgttgtgcacttgtgcctcacccttccagtgctcatccagtgctatatgtatccatgacatttgttacaatgtgcccattctcatttcatacaccaatttgctaggttcctctctttgggggccaatgtgtgtacttcttgtattatcctaattgtatgtgtagtttacactaaggtacttttctggaagattgtacttaagcccacccaaaaagagaaccatggaactagaagatctcatgctttgtcattgactcattgctcttcactttggtcgaaaaaaaatggtttcataccagcagaagatcgaaagtttgattgtgtatatgccaccgaactttttcggtactgtttgatgatcttggaaaaatgcgttaatgttttttctttacaataaaggaagctttattgatataaaacaattaaatcaagatgatacaataatcttagaaccacttttgacttatgcatatctagaatacatatagtctaaaatgtttctggtaaacataatggacacactaatgactatctatccgtagactaaatcagcacgtatatacctaggtaaaaaaaagtttcctaaccacctagtccaaatttgacagcccacataaactaaatcatgtgatcctgtgaataaccaagtagataattatttttcttcttgtaaaaaatcacaatatttctacttagccataaagactaacaatgtagcaatgcacaatgattgtcttaggtagtacatcaaacaaaaatgatccttttcttaattcttcaaaattcatgggtaataaaaacaaggaaaggagatggaaagtacacaactccatgtggctttccatgctcattatcctctatatcaaacaaatgacccttttcaattcttcaaaattcatggccaataaaaacaaggaaaggagatggtaaagtacacaactccatggcttttcatgctcactatccttacaggaggattagacatgtcccttttttccaccagaaggaaataattgatatgttctccagctttggtggtagtagggctttcggttctgtcacgttgccatcactgttgatgccatcaccttggtacgtgctgagttatatgcttcattcaatgcaaagcgtagcttgtacatgccggccgtactgtggcccatcaggtagagccaggcaggccacaggacaaagatttgttcaatgattccatcaatatcaacatcaatgtttacaattgtttttttaaaaaaaacaattggcttgatcagaccagaatgatctttgaagtgatgtctttctcaattgctttggtttttttttgacacgagtgttaatcttgatgcctattgcagtagtttagtactatctgtttacccatcgttttaccaagagctgactataacccataataatatttattagcaaacaaaaaaaattataggtaaaactttgatgtatgtttttaacgatttgaaggccagtgctaaacaataagctatggtgacaaaacattaaaatttaattttggatgcagctgataagctgtagaacgatgaagctggaattcaaatgtaggggctgtaaatggagcttgttattgtatagtttcgtctaatttgcttaatgatgacagattgttcaggaagagatttaggcagcgttcgagagggtgagggagtgagtttgtttgtttcgttttccgcgcgcacgtttcccaaactactaaacggtgtgttttttgtaaaaattttctataggaaatttgctttaaaaaaatcatattaatccattttttaaatttaaaatagttaatactcaattaatcatgagcaaatagctcacctcgttttgcgtatcctcctaatctcctcaatccccttctcctcaaatacacccttagtactcgttcttggccatttcatgttgcacacagctagtactacctccgtcccattataagtgcagccatgttttttcacgcccaattttgaccgtccgtcttatttgaaaattttttaaaaaaaaattaaaaacataagtcacgagtaaagtactatccatgttttatcatctcataacaataaaaatattaattataaaaatttttttaaataagacaacgaacaaagttggacgcgaaaacttatggttgtacttataatgggacagagggagtaagaggatgcatttcccccaaaaaaaaggaaacagcatttgaatatgaggttatcagattagtgacccacatgatcagatgttgccattcccatacctaaaagtttggtttcttaataactggctttgatgtcgactgtcaccggaagatttgtggaagttagtgaaattgctgctgcttctctctctctatctctctttaaggtgctcctgtgtgtaacttggttggttcgttgcatagccattgtcccggcgcgattaatagagaggctgacggatcagtgtgccggagacgcaaagcctggtaaattgtctccaggtactagtggctggcttgctgctactgcttcagttcttctcctctcttttttttcttcctgagacattgtagtaatggcactgttcatcttgatgttctgatagaacggttcgatgatcctccagtactctgcctgcagtgagagtgtgaggtgagtgatatgattcaggaacgacaaaggaagaaaagaaaaggatgcaatcagcagagcaaagctggtacaggatggatgcagccatgaaaggacatgtatgaagtaatatagtggtgaaaccctacttcatctattgcagtttatggctcttttgaatgcagaaatttcatctattggagtagtattttcataggagtcagttcaattttcaaaaaaattgtaactatattcttctgtaccgaatagctgaatagatgaaaaatgtgataattattcgaggatataagcgaatgaattaactattatagagttgaaaatagatttaaatcaatactttaagaaactcatgtataaaaagttcttataaaaatagcatcgtttagaaggtcagaaagcatatgcccctctatccattcatatatgcactgaaaaagaacacactagtcaggctattactcttataactatacaataacaacaccaggaaataagtctagacaaatatagatgattcttagaatgcttcaggccgaataaaaatattaagtgatttttagaatgcttcaggccgaataaaaacaagagacatacagtgttgctacatgaatgaaacctgtagccagggactgctatatactgtctctgtagcagtataaatagcacacgagtattatttgtagttgtactggcaatgccagagcagcatcagcatgagagtattgcgtgctgccatagacgcatgcaggagcaggagctgttcgatgagcagtgacactgtgacagttaagagtgagagtgcttcattcagttctcccaacagcaatgcaggccggacaccggacatgcaatacagtaacacactaacaccagagtatctcacctctaccaactgcctcactgttgttgtagcagcatcaactgtaatttcatagcaataacggttcagatttcagaaggcatggtaagattatacaacggaaacacattggttactgcttaaaatactccccctctcaaaattttgatagagatgctactcgttcaatattgcctccaggttacattttacaacataacatgtcaacacccttgagagatgtcaagcccctctccgtgtggtggttaatgctatctaacaacaatatattgcatacgaagcagcagcactaacaaccatgcaatgaggtagtatcaggagatctttcttcaagatggctacggaggagcttcagcttgtgcttataatgttgtatcttaggtgccataaaacaatagcaacatacgaatttctcctagaacaatcatatttctcctctgtagcctccaccgccatagtaatctcttctagagcccgcgatcgccatggacttctggtgctccagctttggacagtcggtaacacgatggccaagaccaccacagtatgcacatcccttaacaccgctctccttggccatggtttcctcatcttccaatgggtcattgagctcagccaacactggcggtattctttgcttagcttccttaagcaagtgcttaaggtcaagaagggtagtctccgtttgattcttgtttatgaaggttgttgctattccagttttcccacatcgaccagttcgaccaatccggtgaacatagttttctatttcagcaggcatatcatagttaatcacatgctggatatcagggaaatcaagacctttcgaggcaacatcagtagccaccaaaacatccttctttccattcttgaagaactcgattgcattctctctttcctcttgatcctttcctccatggattgcaacagcctctacacccttcagaagaagatactcatggatatagtcgacatcagctttgttttcacaaaagacaagaactggaggtggagtcttctggaggcattccaggagatatataattctggcatcctccttgacatactcaacttcttggatgacatccagatttgccgcaccagctctaccaacattcacaataacaggtttcacaagggcactcttcgcaaagttttgaatcttcttcggcatagtggcagaaaatagaagtgtctgcctttgtgccttgaaatggtcaaaaacctcacggatatcatcctcaaacccaagatcgacaagcctatcagcttcatccaaggtcaagtacctgtacaaatcataaaagggcgttaagcaaactgtaaagcacgtgttcctaacattaagatatcctctagtccaacacaatgtttttcgaacaaaacagaatctgaaacgataacaggcagtactgggacatattattatatgctaactcacctagattgctgatagacagttggaacctgcatcttaactaaatcaaacaggtaaggcatattggcattttggcgcagtagaactatgaaataaaatggcacatggatgcctgggtgggaatagcaagtctcccatgtttcatattccctctgtcccaaaatgtaagcatttctagaggctttcacggaaagaaattaagtagtaggattgaatggtggcaatactttgggacaaattttgtaatcaagaaatagctacagtttggggattgagggagtatacagctattgaagccaaaaatattaatatttagaacctatatatatcatcaaagaataaataatgatgactgacatgtgaggtcttacaaccaaaattcaaacatcatgacacaatactttggtgagatgtgacgaaatgtatacacttcaccatgtacatatattacatattcagggatagttgtttatttaattatttatcagtacagatggaaaaagaaacagttgtgttcagaagaaattttcaatatgcactgcagggacaatgatttgattaagtatcaaagtagcatgtatatcctcaagaattcactttgatttaaaatatcataattcagagctggttgtccactaagaggacttcaaaagtgcaggataataatatagtcttggagcttcggacaattaagagtgaaacaactctaggcccaacgaagagtaaaaaatctgaaggtcttgagtttttgtgtttctctctactattactctatttagtgtgtacagtgcaactctaacccttggcacagaacgagtcatgcgttttatacatgaaagttttcacttctaactcacaaaattttacacatctataaactattaaagtgtctgtgtctattatgttgaagctatgagaacaacccattgtacagggaaggcatacacattagctaaagcgtagtactagttccaccatttatgtggtaagaagaatatgaaactatgacataaatataatatatatattctgcttgtggtagaaagcaccaaattcattgaaaacatccagaactcacctgcaattgtcgaggttcatctttttcttggcaagtaaatccttgagtcggccaggtgtagccaccacaatatgtactcccttcttgaccacatccagctgcgccctcatatcgacacccccaatgcaaagcaacgggcgtatctccgggtacccagcctccttaagtggaacaaggaactgctcaatgacatcgtacgtttgcttggccagctctcgcgatggacagatgatcatcccaaatggcccttcacccggcacgattggcatcatcatctcctcctgtaatgccaccatgatgagcggcagcacaaacaccaacgtcttcccggaccctgtgaaggcaatgccaatcatgtcgcgcccggagagcaccacgggcaatccctgcacctggatgggagtgggctggacgatgcccttctcgcggagcttgcgcagcatgggctcgggcaggcggaggtcgcggaagtcccgagcgggcggcggcacgtcgtccccgtccacgaggatgtgccacttgcggcggagctcgtcggccttggcgcgcggcatgcggcggaggcggagcggcggcttccaccccgtcttgagcgggtcggagtaggtgatccccttggcgagctcgcgcaccgacatgagcgtcttgcggtcggagaggtgctcgatcatctccttctcctgcatgatgagctgctccgtgtgggtcacctccggcgcggcccgcttgagctgcgtcgccttgacgaggaggctgggcttcgcggaggcttcgaggccgccaccgccaccgccggctgagggctggttcggcggtgggggagggggaggcgggagatccgaggcggcctccgcggcggaggaggatgggggcgcgggcttggagaggcggaggcggcggaggcggtcggcctccatggcccggcgcttggcgacggggatgtactcctcgtagttgtcttcgtcatcggagttggcggcggcggcggtcgccggcgaggaggccgtggcggcggccatggcggggggattagggtttggagagggaggcggagatggggaattcgcgaggaggaagaatcgacttgatccgatcgggtttttttttttctttttctttttcgtttttttcttctgtcgagattgagagctgagacgcgtatcgatttaccgacatgagatcgtgatggagattgggccgtaagagctggatcctggcccataactacatgtgcctcaatctcaacccaggctgaatatacagcccaataacccatcttgtgttgtactccatccataaaaaaacaagggaccacctatacatttgtcgacaaattttctactaaaaatttgacagatgtaattatagtacaatcgtagtgtaattacaatgtaacttgtatgtaattacactgtaacttgcatgtaactacagtgtaacttgtatgtaagtttcacgtaattttgaatcgttggatctattacaagatttgttctatggaggaagaaaaaaatcacatcacacacatatatgaaagaatttattcccacgacctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgaaaaacaatatatcatccaatattatattgatttttttttgacgagggagtaagtaattgtctcctttgtttaatgataatgtcttcaatgtgtgactttgactttcatttgtaaggtaaaataattactttctccttttgcatttatttggcattattggctttttcattgttttccctttgaccactaagcatttaaaaaagattaatatgtgatgaatgaaatactatttctatgtttaggatgaaacacactttggtgatataatatattttctataaatattttgtaaaataagacgattggtaagaattttgttgtgatcgtctaatatgtggttgttttgtctatgcaaaagggtcatacataagcatgtaaggttaatattgacatataagaactggataaggtaacatggattgaagggttccaagtgatatacagaagtgtgttcgacttttatcggtgtgcagtaactaaatgaggaacacaggtggctttttgtatttgggccctgtttagttccaaagttttttttttccaaacttctaactttccatcacatcaaaccttttatacacacaacttttctatcacatcgtaccaatttcaacgaaacttccaaacttcagtgtgaactaaacacagccttggtttgagccaggggcggatctacgacctggtgaccctagacgtccaggctcgtcaacgaataatctattattaaaagtccatcctattaaaagattaaataaaatctctatagtaaatactgctatctatagtaaagtgtatttggactttaaaatatttatagcttcgttactgatttgagtaacacaaatagttcattatgtttggtttacgagataggatgtgacaaaacataattgtgtaggatttttttcacgttgaacaactgaatgagaaacacgaataactgaatgaagaacacggaagattaaggtgtcgttgtacgtaacacccctaaacttatgatctctagtaccctagacttataatctctactgggaaggagaggtaattaatcatatctgggaaggagaggtaatcatatgctttgctcagttgtagcttagctgtatacatccgattggatgtagaggctaggtttatcatattttctaaaataaatatgcttagttgtagcaatctcagttcaagcatttttactttgctataataacagatcaaattatataacaacatggttttgtaaaattaaaacgtgctgttttgcgaaatttactaagtttataatcgttgcattcggtaaaagatgtttatacgacatccggaatgcaatatgtgctaatgtgcaagcatttgtgtgtttgattcgtgtaactgtttctgaattactcatatttcaccatctcattattcgcgtgataattgatcattagaatttgagaattggaacatatataaaggacacaaacatatatatatatatatatatatatatatatatatatatatatatatatacgaggaagcgatgcgatatcagtgcagaaatttttctgaaacaaaatgagtacatcatcctcctctatcatctccctccttaattaaatcatcacagaataatcatatatttactccgtgatgcagtagtatagtgtgtgacgaaaagtcggagcagtaaataaataaatccaaaaggcgaatttacgaagcaagcaagcattagtggttattaatctccttcaattaaggcctcctcctccttaatcaacggcgagggtggtagtgctgcggcttggcggcggcgccgtcgccggcgggcttggcgtccatgacggtctcgaaggcgccgacgagcgccttcaccctgctgcactgccgcttctccaggagcttgctccgcgcctcctcgatcacgtcgttgctccgccgcgccatctcccgccggcgaggctgctcctcctccgacctcttctccatcgccgtcttcaccctgctccccttgaacctccgcaccagctcgtcgccgtcggcgtcgtcgtcacgctgcttcttgatcgcctccttcaccaccgccacgaacttgtcatcctccttcaccaccgcgaagaacttgtcctcctccttcaccaccacgacgaacttgtcctcctccgtcgaggaggcggcggcaggcgagtcggtgggcactggagtagcagcggcgtcgcctttcttgggctcgtcgtcgtcgaccacctcctcctcttcgatgatggtggtggcggtggtcgcgatctccttctccggctccggcgacttgatcgtgttcggctcttcttcctccaccgccgcgacggcgatcaccaccggcgtgttcgcctcgtgtatgatcttctccgggacgacctcctgctgatcttgccttgcgccgccgccatggacgtcgtcgtcggtggtagtgatcgcatccaaggaaggcacgctcgccgacgactcggagcccttgccgttgaccgaggccgagatgtcgccgccgccgccgccgacgccgacgatgacgtcgtccttgctcttcctccggcgagacgacttgctgcggcggaacgcgcgggacgcgcgctgcatgagcttcctcggcgacagcatcgacgagtagtaggacagcggcttggccgtcgccgccttgtccttgtgggtggcggccggcggcggcgagtcgtcgtcggtcctgatcgtcatgcagctgatggacagcgacctgaggtggtggcgcgacggcgccggggtggcgggcgtcgacgccgaggcccgcggcggctgctggtggtggcggcgcgaggcgttggagctggacggcggcgaggtgggcgccttgccgctcgcgctccgcggcagccgcgacggcgacggcgacgtcgacgaggaggccatgggctgcttcggcgacgacattgtgattgtgttagggcaaacgagaaaaacatatatattacgattaaatatgaacttagatctatctttctaaagctggctcatctcatgcggtgttaaattttaagatgaatctaatgaaattatacataagaaaaaaaatagcaaaaaggaaagaaaagacacaaatccaatttgcatggacttcccaattatctataatattcataagaaataaataccaagaagtaaacaaaagagacatatcatcttaattcacatataccgtatttgcttttaacggttccactattaatcgtgacatatgcaaacatatactccgtattgtgttgatcaccaagattaccaagattgatagtcgttaaattcagtatttaccctgattttttttagatgatgaaccgatcacagtaacaaaagagaaagtgatttatggattaaaaaggccaaataaaaaggcttcttgtttgtttaggttagacgttttagcttataagcccaacaaagagaggccataatccaaacttcaattaataaagaaaactcacaacaagattctacatctacatatatattctttttcttaaaaaaagatgcatacaataatccttttattcagctccggtgtataatgacataatgaaatccctacatggtaggtggctcataccgtgataaatcttgacgtgcacatattagcattgctcacaccataacacacttgaacaacatcgtacgtatagcatctctctatttttttttcaataacattaattgtttagcaagcatctaatgtgaatctcattttttttttcaaaactagaagaaagagtgaatctctaacagaagcgcaatacaattatctatttttctttttccaaaaccaatacattattatcacattttgttttcaatattcttgcatttcaaacaagcctccaaagacaatagccaccaataacaataacgagttaccttgagctgagtggtcaccttcatttcttcagatatgaagatgcgatgatggatttgcacacactacacaaatgctatgaaaaatgaaggaggccgagagccattcaaaggccctcagatggcctaaaactacacgatgatgagtttgtgggagagatgatggtagaggaggaggctatcgagaaggtaacaaataggcgaattttaagatctataataatagagagaaagacggagaagcaaacaattaattagagtcctacaaaattacatgtgttaaagaaaaccatgctaatatttgtatggtcgacaatttttcagtgtgatggttacatgttagaagctattttgacttggcatatatagttagatccattgacagccaccgcttaaatccagcagaaccaataaaacaacatttgtgtgcatgtataccaatctacaatgggtttccatattatgcatctagcttaaattaagccctaaaatgacattactggatggccacatcgaaataacactaaagtcaaaaccacagtgtagattaaaaaaataaataaccaaatcaatccagcactgattaataaaaagctacccagccttgcaactgaagtaatgaatcgaatcaaatatatatatatatatatatatatatatatatatatatatatatatatatatatatatatcttcttccaaaaatgaataaaccaatcatgaacagtcataccatctattgctttttttttaagaaccattgggaagaatggatcgtcaaatcaagagaaattgatttattatcaggtagccattcttttctttttatcatcttttactatccctccttggaggtaaagcatctccatctagattctagaagcaaaggccatcgactaatcactgccgtcgaaacacaagtgaacggttcgatgcgataacggaaaggcacgcgaatacaagtggccaagtggacggttcgatgcgataacagaaaggcacgcgtattcgtagcaagaaaaaaaaaagtactccccatctcaaaatataatattttcagaatagtatcaaggcaaatcattttaacttacattattaatagtaaaaaataaaaagaagtaatcatgtaaaattgatgatactagatttattattaaataaactactccctccgtcccataatataagagattttgattttttcttccatatttgaccactcgtcttattgaaattttttttgtatttgttatttattttatttgtgacttactttattacccaaagtacaacttttcgttttttatatttgcacaaattttttgaataagatgagtggttaaacagtgtaagcatcgaaagttcacgtttttggttttatagcaccgaaagttaccggttcactttaatagcacccaaagttcaccatgttcccatttttaacacttccgtcaattctcgatcgttttccgtccgtcttgatccagccacacacacgatatgacgtttctacccctcacaagcacaagtataatgcatgtcaatgaggggtagaaatgtcacatcatgtgtgtggctggatctataacgatcaagacggacggaaaaattgacggaagtgctaaaaatgggaacatggtgaactttgtatgctattaaagtgaaccggtaactttcggtgctataaaaccaaaaacgtgaactttcgatgctatatagcaaattttgccaaagttaaaatcccatagggagtatcataatatgcaaaacttttattgaaaatatattacttttatagatatttatagatattattggataaagtagcataacactaagacggtgttgaaataggaaaatgattatattttaagtccgagggagtattaaaatataaaaaaggggaggcgaggaacgcgagaagagaaagcagtagagtggtaggcgagtcgctgggcagcgagggagacagcgcggcggcgaggagatccaagcggcggcgggcggagatggcggcggaggggaagacgagggtggtggtggtcggcggcggcatcgccggatcgctccttgccaagaccatgcagccccacgccgacgtcgtcctcctcgatccgtaagcctagcctcgcctcgcctcgcctccgcaagttcccctcaggctcgccccgtgcttgtggaaatgcctgctcctagtgtatcgttgggatctagcttgttctagcgattgttttttttttatggaagacatgtcactggattggatgctgccgtactgggctgacaagtgcatttagctgctactatgattttaggtgtaggaaaatgcgcgctgattttaggttgggaagccatgtttctgcgttttcctagcatttgtctggccccaggtaatcgaggatgtttctgaagcatcataattcatagagccgtagaggatgaatacgaatttcatcaatttaagttttgaaaaatgcggggaacagcctgaaagggttgcatgttctgttcaaactaagagaaattttacggtccttaagaaagtaccttaagctactaagattttacactaaaaattttggtacctcgagatacctagtacctggagataacaaattttacactagaaaatatggtacctcccggtacctttttaaggatggtaaaattactctcaaactaattgcataacgaactctacatgactgttttccatttaacttcaatcaacaacatacgggatgggtgtaattgtttcctcgatttcgctggcatgtactttgcggtccagtgagttaatgccataagatgagtttccacttactttttgttgattgtgatttttttttgtgctcgcccaagttgctcatccttctgtacaataagttatagcatctcaaatgatgcacaagtaggcttgttcatatagaatgcagatcagttttgctgaaagtttaatggttatgtcctctgcgaatctatgcagacaataaacaagcttcatacccttacacttaagtatcatcaatcatgtcataatcggctatatcttctgatgacaggaaggactatttagagatcccttgggctgaattgagatcaatggttgaaccctcttttgctgagagatcattaatctatcacagagattatctcaccaatgcaactattgtaacctcttctgcagtcaatatcacagaacaagccgtgctgaccgctgatggtcaatctcttgcgtatgattatctagttatagcaactggccacgcattaacttctcctgggagcagaagcgagaggataaaagaattccaaagaggtaactggagttcaagcacatagtgaaaagttgatttctgaccttatcttcctacttatgctttgtaatcttgttgtagataaagggaagattgaatcctccgaatcagttctgataattggaggcggcccaactggtgttgagctagctggagagattgcagtagattacccagagaagaaggtgacccttgtccatagaggatcacggttactagaatttattggagacaaagcttccaaaaagtgtcttgattggctcacttcaaagaaagtagatgtgcttttccagcagtcgattgacttggattcattatcgaacacagagaagttgtacagaacatcagctggagaaacagtaacagctgattgccactttgtgtgtatcggtaagccactcagttcatcatggctacatgataccattctaaaggaatccttggacaacaagggaagactaatggtggaaaaggatttaagaataaaaggttataataacatttttgcaattggtgacatcacagatattcctgtaagtctactttaaacttgcacattctgttattcgatctacttgcagatgttccattattccctctgtttgagaatgttctgtacaactgagagttcttattttggctactactgagggaggatgaattgattttcttttcccaccatttggcacatatcattgactaaatcaagatacagctcaaacttgaacataatcaaatattctgcttgtccttgtagactgatacattgattacatgaatgcacatctggtgtgttgtgatgagtatacactgctttttattcatatctaaaagcctatatctttttttacttaagaaaacatttcctcccatagtatcccctaatggaactttctgtgattcgtatatcactttctgggtattgaaacactttgaaatacgaatctgaagtttgacttttgcatgtccaaaagaactgtacattaacagtaacacccgttaatttttcaggaaattaagcaaggttaccttgcccataagcatgctctgctagtagcaaagaacttgagattattgattaaaggttctcctaacagcaaactggagacttacagccctggatttgcattggcacttatctctcttggaaggaacgaagggttggctcagttgccgttcctcacactcggtggctgcttaccaggcaagattaaatctcgagatctgtttattggtaggacaaggaagcagatgggtctaaatgcttgaagtctttcttttcaaacaaatatgcttcgcccatattgtgctgtatctgcacaagtaaagaatgatggtgtgaaattgtgaatagcaatggactatgtgcatttactttgtatgctgagatcttttgccattgtaatgggtgtgacaatcaattcatggatttgtttgttggttggcaactgaatgctacatttgcttgtctgtaatgatattattattgtcggcgacgaatatttgataccaaaagggctcctgtatgaaaaagagaagatacttgtatgcacggattttggaacctccaccggtaagcacataacttgtccgaattttttatttttttcaattctttgtgaagttggtcaaaattattcaaaggttcaaatgatttcggccaaaaacaagcatcgaaattcccgaaaactagtgtgatttttcctaacataaaaaatatgtgtcagagtgctgctgtatagcatttccgttaggaataagttcaccggaggtcccttaacttaacagcgagattttttttagtccctcaaccacaataccaaaaatgttcgcccctaaattcattcaaaccgttcaccggaggtcccttagcagtataggtgggtggtttcgctgacgtggtatcctagtcagaaaaaaaaatcgtgaggcccacatgtcagttgcactttttttttcttttcttttcttcttctcttctcttttctctcttctctttctcttcttcttcttcagtgtgagtgaggccggtggagtggcgatgcgcgggcggcgggtccgcgcgacagccgagcggtggcgggaggcggcaggcgagcgcgaccggcgggcgagcacggaggaaggaagtggaggaggaggaagagtggcatggggaggaggaatgtgtagcggccgagcgcggcggcgggcgagcggacgagcacgacaggcggaggagggggccgcaacggcggaggtggccgaagaaggagcgtggcggcggtgggcgagctccgccggcctactccgccagccgcgtcgtcgtcggcggcgagagccgcccccaccggagcccctggagagcttaggggcgacggcggatgagcacgacggcgcgccgccgaccgaagcagtcgccgccaccgcgtctccagctgcagacgccatggaggccgaagagggcggcatggccatcgtgtacgacgcgcggctgcctcggctgcggtggaggaggtggaggacgccaccgcgacctattccgtgttccgcaacgagatcacggcggctagggacgcgctcgtcgatacccgccgccgcgctggcccgccgcccgcccatcgttgctccgtcagcgcggccgccctcgcctgccgccgcccgccgccgcttgtctgccgcgcggactcgccgccgcgctggcccgccgcccgcccatcgttgctccgtccgcgcggacgccctcgcctgccgccgcccgtcgctgcttgtctgccgcgcggacccgccgccgcgctcgcccgccgcccgcccatcgttgctccgtccgcgcggacgccctcgcctgccgccgcctgtcgctgcttgtctgccgcgcggacccgccgccgcgctcgcccgtcgcccgcccatctttgctccgtccgcgcggccgccctcgcctgccgccgcccgccgcgcggaccctccgcccgcgctcgcctgccgccacccgccgctgctcgctcgcccgccgcccgcccatcgcctttccgcccgccggcctcactcgaagaagaaaagaaagagaagagagaaaagaggaggaggagaagaaaagaaaagaaaaaaaaagatgtgccactgacatgtgagccccacgtactatattaatttttttttctgactaggatgccatgtcagcgaaaccacccacatatattgccaatggacctctggtgaacggtttgaataagtttagggacgaacatttctgatattatggttgagggacctcaaaaaaatctcgctgttaagttgagggacctccggtgaacttattccggcaaagtacaccgaaggtccctcaacttgtcatccggataaaaaacgtcctcgaaccacaaaaccagatatatagagtcccttaactatacaaaaccagtcacccgagatccttcggtagttttgacccggttttggtctacgtggcggctgagtcagcgtggaacccacgtgggccccacttgtcaggatgccacgtaagccggcctctccccctcctctttctcagttcctcctctctatctgcctgatgagcgcgagcggcgaggcttccaggcgagcagatggctgaggactcggcaagcagatggccgaggaccacgacgcggaaggggtccggatgacaggcgagggcgcggccgacggctgcgacgcccacagcctcgccggcggagaggaggagatcggcgaccagcgccgccgccgccgcgcttcctccacgcaccggccaccaccgcctccaaggggacctcgccgtgggcggcggccatcgtcgacctcgccgcccctagggccctccacgccggcgcacgaagggctcgccgcggaggacgagcggcgtggagctccagacgcgccgccagcgggaggcgagcgcggcggtgcgagtcgcgtccttgacggggaggcgggcgacgcggaggtcgtcggggagagtgctaacgctgtcctcgccgtcatagccctcggcggcggaaagcgtggcgccgttgccggaggcgggatggccgaggaaccaccggaggcggcctctgacttggaggcggccttggacgtcgcgaggacagcggcgagcccctcgtgcgccagcgtgcagggccctaggggcgccgaggtcgacgatggccgccgcccaggggcgtcctcccggcgtccaggacggaggtcgccatgaaggtcgtgtcgctgtcgcacgacgcggagcaggggatgaggcagttcgtcaccgaggtcgtcagcgtcggccgcttccgccaccgcaacgtcgtgccgctgctcggctactgccgccggagaggcgagctcctgcttgtctacgactacatgccgaacggcggcctggaccagtggttgcacggccagggtgcgccgctgctgggctaggcgcagcacgttcgcgccatcagaggcgtcgccgccggcctgctctgcctccacaagggctgggagcaggtggtcgtacaccgcgacgtcaaggcaagcaacgtgacaacgtgctcctcgacggcgagatggacgcgcggcttggcgacttcgggctggcgaggctgtacggccgcgccgccgcccatggcgcggtggctgctggcgcgtggaggaagcgcggcggagcccgagccgtcaggctcgcggtcgcggaggatggccggcgcgccggtcgacgggctcaagcaccggtcgacgtcgacgagccggcgaccgcgagggtgctgcacgaggaggaagagaaggaggcgccagcgtggcctccctccgcctcctctcggcctcctccgcctcctctcggctgcgagccgccgtctcagccgctccacgctgctactaggctactagctgggcagctggcttcttccaccccgccgcggcagcgccggagccccggcgaggtccgaccccgtcgacgcggaagcgaacccaaggatgccgccggtgggcgcccgacgcggccggtgtccggcgtggcccgccccgttccgccgccttggcagcgcgcgcgcgcgcccttccgagggcggccgtatgcccacaaggtattcgatggattgaccgacctgttctgttcatgcagtagcgggaaacgattcgttcaccatctagtttggcgtggaaggtattctacggatctttctttgacatgcgtttttttgtttgtttgctcaatgacatccaatcaggtgttcaggctagctgcaaccgtgcgtgattttactttggcttcacttttttatccatggattttatattccagttagtaatccgagttcctctcttaatttagttcatctaagaagacgttgtcctgtccttcgggcaaccatatacctgcaacgatgtctcggaatagcttctagtccactccaggtatctgtgcaaaagcttcaggatatatgtatacaaatgcacgcacaacatgtcggctataagtctatctgcaaattcgatctctttctggacaacacaacaacaacaacaccacaccagtacatcacaaagaaaatccctgtgcccacgaaagagagcaattaaggcatgagtgggggagcggagatgatcgcaggcgctgtcgtgcagcgtgttgccggcatgctgggtgataacgcctgggagaggatccagctgctgtggaacttccaagaggatgtccaagatatgaagagcaagatgactgacctcaaggttgcacttagctatgcagacaagcactctagagagactgacgacgacgcattggtgctacgacattggctcaacaagtacaagtctgttgcctacgacatggaagacacgttggatgagttgttgactaatgcgatgatatgggaaaataacccatgcacggtgcgttcccttcacatgcttgaggttaattaattatctgattgggaaaagcatatatactcttagctgttaaaacttatacataggagaatgtatttaattgtattattgtaagaagcacacactcttcatttgttgtcaatactaagactgtgatttgtgaaccattaatgagctggtccagctatagtttcctacatggctgcattgtgaacaggcaccaccaaacatttgatatttcatatttgtgaacatataccaccacgttttggttgtcaccgttggtatacacaacatggccaggcattctcactgttataagttaattttccaaaaatagaaaaagtatttatgtcctaggtatgagtctacttcataaaaaatataatcacccattctttctgaataagagatacagttgtggttatttgactaaattagaaaatgctacaggttaaattgttcttctcatcaatcaacccactcattgtgcgcatcaccatgtcaagtaagatgagaaatattcggatgaagttagataagattgctgaggaccagaagaaattcccctctatgcaattggctaacccaactggacaagacagtaccgataagtggagagaaacctttattggtcacacagacgaaattgagatggtagggagggcaagagagaagaaagagatattaatcaaggtgttgcagaacgatggaggccaagaaatctctatcattcctgttgttggccttggtggtatgggtaagactacattggccaaagctgtttacactgacaaggagacacatatgtttgatgtgaaagcatgggtccatgtctcaatggaatttcagctaaataagattgtgtctggcattatatctcatgtagagggcagcactccagctaatattgctgatctacaatatttaaaatctcagctggatcgcatactctgcaacaagttatatctcataatcctagatgacttatgggaggaagggtggtctaagttggagaagctgatggaaatgttgcaatctggaaagaaaggaagcaagataatagtgaccacccgtagtgaaaaggttgtaaatacattatctaccattcgtttatcatattttcataccgttgatccaattaaactggtgggtatgtcaattgatgaatgttggtttatcatgaagcctcgcaatatggaaaattgtgaattctctgaccttgtagacattggaaaagaaattgcacaacgatgcagtggagtacctctagttgctaaggctcttggttatgtgatgcagaagcaccgcacaagagaagaatggatggaaattaaaaatagtaacattctggataccaaggatgatgaggaaggaattctgaagggtttgctgctaagctattaccacatgcctccacaacttaaactttgtttcatgtactgctctatgtttcctatgagccacgttatagatcatgattgcttgatccagcaatggattgctttaggatttattcaagatactgatgggcaaccacttcagaaggttgctatggaatatgttaatgaattattggggatgtccttccttacaatcttcacttctcctacagtatgtaaaaatgatgcctacctcattgaattatgcaattgaaattatttgtcttgaagatctgaattatgctctccttttttattgccaaggtgctggcttcaaggatgttattcaagcccacactcaaacttcatatgcatgatatggtacatgagcttgcaagacatgttgctggtaatgaattctctcacacaaatggtgcagaaaacagaaatactaaaagggacaatttgaatttccactatcatttattgttaaatcaaaacgagacatcatcagcctataagtctttggcaacaaaggtcagggccctgcattttaggggatgcgataaaatgcatcttcctaagcaagcattttcacatacattatgtttgagagttttggatttgggtggacgccaagtgtcagagctaccaagttctgtttataaactaaagctattaagatatcttgatgcttctagccttcgtatctcaagcttttctaaatccttcaaccatctattgaacttgcaagccttgatactttcaaatacttacctaaagacattgcccacaaacattggttgcctccaaaagctgcaatactttgacctatcagggtgtgccaaccttaatgagcttcccacctcttttggggaccttagtagtcttctcttcctaaacttagcaagttgccatgaattggaggcgcttccaatgtccttcggcaatctgaatagacttcagtttctgagcctatcagattgctacaaactcaactcactgccagaatcttgttgtcaacttcatgatctggcacatcttgatctgtcggattgctataaccttggaaagctcccagactgcattgatcaactctctaagcttgagtatttgaacatgacaagttgttccaaggttcaagcgttgcccgagtctctatgcaagctcacgatgttaaggcatctaaatttgtcatattgtctaaggctagaaaatctgccctcatgtattggtgatttacagcttcaaagtttagacattcaaggctcctttctccttagagacctgccgaatagcatttttaacatgtccacacttaaaactgttgatggaacattcacatatttagtatcttctaaagtagaaaaactgagggagaatctgaaattggaaggctgttgtaagctggatggaggaagcactgacctatgcagtcggattacggaactaaaaaagacacactgccatgaattagagatacaaggtcttgaggattttaagcatttggaagggatagagcatgctatacttctcaacagcttgaagcttacaaagttgattttttcatggcaaccgaagcagtatacaaatgaaacggctcatcacaaaacggtgcttgggatgctcgtgcctcctagaagtgtccatcaccttgctatcaaaggttattgtggcatcgagttacctaagtggatgttggatattcgttcctacctacctcatcttaccaccatctttctgcacggtctgatggaatgcaaccgcctccctccacttgggtgcctaccacacctgagagcattgttaatgaccaaaatgcctaaaatcaagagtgttggtccagaattttatggagactacggaagctgccagaagctaagaatgattatcttggcttcaatggacaatttggaagagtggtggacaactagatcatctaaacaagataacgaattatcattaatccctgatttacagatgttgtgggcttccgattgtccaaagttgaaattcctgccttatccaccaaggagcttgacatggttcatagagaatagcaatcacgtgttgccagaacatgggtttgggaaccttacatctgctacttatccacttcatctttccatcgagcgtgcacccaattctcgcgaaatgtggcgtagggctcagcacctttcttcaatcgagtctcttactctcatgtctatagctggccttagagccctgccagaggctattcagtgcttcacgtccctctggagactcagtatattgggatgtggtgagttggagacgctgccggaatggctaggagattatttcacttgtctggaagagatttcgatcgacacttgcccaatgctgtcttcactgccggaaagcatacgacgcctcactaagctgaagaagttacggatcaccaactgccctgtattgtcagagaagtgccaaggagaggacaggcacaagattgctcatattctagagcccatattcctgtaaaagaagctcccacctagatcagcaggcatacaggccgagatgtagcatgcatggtgagatgagacatatatatccctcttgattgctagtagtagtaaaatgcgtgccagttttcctcaacttttgtgactcttgtctgcatattgcaggttggctgatactgttagcagggtaagtttacaaaacttttaaggtaatatgaaaaactatttgatctttcaccagcggatctatatttgaactagagggctgggacctcatacgtgcaggcaattggaccgtaaagcgaaagcggctgcttatgtacatatattcctcgactacatatgctgcttgtgccactaccagacttcatacttcagagctatcctgagggtggttatttttccgtgatttgttggtcactttttggctattgaaatacttgggctggtataagcatcataaatttcgcttttgcatccaaagaagttgtgcattaacagtagcacccgttaattttcaggaaattaagtgaggttaccttgcccaggctctgctagtagcaaagaatcttgagacttattgattaaaggttcttgtaacagcaaactggagatctaaaccactggatttccgttggcacttgtctctcttgaagaaacgaaagggttggctcagttgtcgttcatcactctcagtggctgcttaccaggctggattaaatctcgatatctgtttgtcagtaagacaagttagcagatgggtaagcatgatgcccatttcctttttattttcacgcagatatgcttcttgagttgttgctgtgttgtgttcttagtatgttgtatctgcacaagtatatgatgatggtgtgaatagtaatgaacaaagtgcatataccttgtaaacagagattttctggcccattgtaatggttgtgataatcatttatgcatttgttcgttggcaactgaacagtacatctgcttgtgtgtaatcacatcattaatgtcagcaatgaatatctgatacccaagaggcacctgtatgaaaaaagaatatacatatcttgtcgactgcaatgttgcaaacacatccatgaaaagatgctctgagtgatcctgaactggatgtaacataacggtgctttctcagaaagaaaatgagagagaggaagatcctgagcctggcaagaacagctatgcaactgtgcaagtacaagccttgaaatcttgaaaggtacatcctgtcgatttcactcctttttgccctgtattcatgagccgtgaagaggagacatctcattgcaatcctgaattttgggagtgtgtgtggcagatgctcaatttgtttggtctttgtcctatgaggtttaggttaggttcctggctcttcaactttgacctgtctgtatgagggcaggtcagctggaatttcttggaatttttgcaagttgtgtacttcacttgtactaccgaatcagccaaattttaagcagtatttgttactaccattcacaagttttattatagagatgacatgatggttagttgatgacccaattaaagtgaccattcattcatgtcttttttttttaaagtgatcatccatgtctcttttggggaagaaacaaagttctctctgttgatggattatgttattagacttgacatgaacctggcttatcttatctgcttaggatgattggatgcacattgcacacacaaaaactgagaaatatatatacaaatataatacaaactggccatatcccaaccaaattcgcaattcaagttcagctaaatcttgaggtggagaaactaatcaccaatttggtttctcatcttcttgtgatatcaacctctatgatgaacctggcctaactccagaccatggtgcagccaaaaggctcaaaagaacaaggccccacagaaccagacacaatgtggtgctgtctgatttgtgaagtcagtagataggttgcaaccagtgaaacacctaaacctaccctgtaaatagtgtaatcaaactccagaaccctctctatgtagcagttttgtataggccagaagaaatcatatcatcttatcctaaatcttccaataaccaaaatatatatcacatcaggtcgatgccatcatcctaaccactcctgcaaagtagccatcacaaaccatttacattagtttcttcttcacacagtatacatggattctcttttcagaaaaagtaaagtgcaccttagttagaagcctgaagttggacatgcattttcattcacatattttatatttgcatggtttttaatatctcaagtggatgtacatgtatatgtatttatgatttgcaaatccattggttttgacctttcagaaaaaaaaataatctgatggataaacctgcaaaatagcaaagctgttgcttgctagactcaccacagacaggatccctctgaatctgaattcaggagatcttgcattagttgtaacccaacttcttatatacatgtgtctcaactatatgagtagttgcaaccatataaaatccctgcattaagctttgcaaagctgtgagataatgcttaatgctaatgcctctagttagtgctatctgagtggagtgattagtgattagttggtctaaagaaaaagattgatatcaccaattgtgcattgacactcatgaacaaaacaatcagctttttgtgactttgtccccatgctatgattggtaccatacaagtatacatggatattttatattgtagccatattttaccatgcatgttggcacacctgacctgaaatggaacagtgctctcttgtctcccaactgtttgcctgtgacatttccttggctccatcgcaggaaaaaaacaattttttaacacagtacgaaaatatatactcatataaagtgcgcacgcattccaatgaatacacatacaccctattcatatacccatatgaacatcttcgaaagattatgtcagtatatcttgatattaacgaagtcattcatataagtacatgggaaagacttagtcaacatgattgacgagtcaccaaacacctcactttcgatgaacacattatctaatactgaaaaaataattaactttaaatacgaacactcataccgagttgtagattccaacctagataaatgagtaggtttcacaactaacgtaatcaaactaagctgctcaattgtattcatagagattattatctaagtttatatgtacatactgtctatattaatgtgccacttgggctaagaaacagatacacacacacaaacaaatattaatgttttatctaaataaccaaccaaaaaatatttaatgcttttatatccaaataatccaactacgatgctgacattcaggccgcccgtttcgcttgctccagtttttttttctcacgtgcacgcctactccacattactacccatgcagtacagtaccttcccccgggcccacatgtcatagagcgggggtacgtacaggcactgtacgcgtaggattctcccaggccagtagtacacccgaaacacgcaaagcaacaaccactacccagttcggccttaacgggtcgggttttgaactcccggacccgctaagccctccgctaataacctcgcctcgcctcggatccaaccaagaaggaatccaagccaagccaaaggtggcccatttctcggcttctcgctgctcttgctttgcttcgcttctcctcctcttcctcctccttcctcggcggctgctccggctcggattccggtgagccgtcgcgttcgtggtacggcggaggaagcgaggttgcgccctttccgaccgtttcttggctatccgccccgattggagaaagctgggtgtttcttttttctttctttttttggttcagggatcagagaagttcagaactggtggaggtgctcatatccgcgaggttgatgtctctccctctttccatttcattttggtttagtccaagaacttgtgttgcttgatgctgtgtggtatgtggtggagttgctgcgattttgatgtgtttttggagtgatcggttgttcagttgtcatttggggatttttggaagttttcgggttttgggatcggcgaggaggccgaaatttggagcgttttgtgcgtaattcgttggattgattacgagtgagaggcgattgattctcctttcagtagagagattattttcgtcccaagaatagttttcatggcgttacagttttgtctacgaatttattgcgtgtgtgggttagtgattttacagctataaaatgtgtttattagtggtggttagtcaaaaggtttagagggattattacttgacaagagtatgtggatagacgagtgatgtcagcacataaaccttatcaatgatcatgtcatcatacatggagtgcggtcccaatcctttttttaatctatcttgaaaatgtatttttgtgcactaaggttaattaattaattaattaattaaatcatggtctttcattggctaaactttgttctttgtagtggtttgtctgagttttaacgacattcgacaatggctgctgtggatagtatacgatggccttaatattcttaaaaaaatatgcgaggtttgttcaggacttaactactcaagtagttaacaattattagtgttttcgttcctttcaataaaaaatatattagggttgtttggcttatcttgaatcagtgttggtcgtcctgttggactttttgtcaggcgactcattttgtagtaaagcatatttgtttcactgctgatgactctaatatgtcaggattactgttgattctagtgtcagtttcaaagcagttaatctgttatctgaataataacatgctcctgtagccaacctgtcaccgtttatgctgattgttcttgcttgctcattcatctcttgtcatcgattctctaggctttgttgaaactgaataaaatttcaatctctgtagtcagtaccacctaatcatatggaggattatccaagtgggagatcaaaagcagctattggatttctcagaagaggtggtggtttctcttcgagaaatcaaagcactgaagagaggaccattcagaactatgatggaccaggaatcaccacaagactcaatccgatgaaaaccaggctgtctgataatcaggagagaccaagatacctacgtgactcattcagatcttcaacctcaatggccattcatggaagctcttccaaagttccgcttaggaaattcggtgacgaaaaacgaaggcaaacgttgttggcaggggtagacattgctgaaagtagcagcagaaatgctgggggcaaacatctggagggtagtaataagagaatcgttgtcgatgataggagttcagatgttctgcatactgaaacagaaggcttggctactgaacaagaccaattgatagcacccaatgctggagtttctgattctgctagttcgtcagatatttctgaacatgcagttgaatccttggtaaggagtgctgctccaagttctagaacccgtagacagaaggacaaagaattgaatttgggtcaatcaggagtttgctcttcgtcatgtactaacaggcctactatatcaagatatgctcctgccgatgtgaagcgaccgtgtaatcatgctagcggagtacaacagcatggtcataacaatctggactgtacttcagtacctaattttctgccatcaggttgctcatctggttctgtttatagcaggaggtttgatgcaatgagaaaaaggacttctgatgggggaagtttttctagatcaaggggcttaagtggaacggctagcttagacgattcacctcctgcataccctgccattgctggtcctagaatcagaacaactacaactgaacgggcttcacaacaaaatgcactaagaagcagaaggaattttcaggattcagcagtgtcagtaaggacaagaagacctccttggggtgctaggttcaggatctctgaggaaagagaggatggcatgatttctcagcgtgattcttccatagggaatcaacagtcagatcaggtgcattcatcttcggaagaggcctctacagagagctcctcaagaccattctctgcagaattacctcatgcaatttactcatctagaggagagggatcaaatgctttcactgcaaggagaagaagatcaagctccctttatgaggaaagacctccacagacattccatgatcttttcagagaaagaaatggccgaagacacatatccatagaaggaattgcagaggtcattttatagcagctccgtttttttctctctttccgaagatagattttatgtaggattacatcactatttttactccacatgcaggtattactagctctggacaggattgaacaagaagcagaactgacttatgaggttagtttctttgcctttgtgtcaaaataattccttgtgattgacttttcacttggaatctggataaattttggcagcaattgatggtgttggagacaaatatattgcttggtgctttcacctcccatgatcagcatagtgacatgcgcatggatatcgacaacatgtcctatgaggtattttttttactatgtttgtttggacctggcaaaaactttgttagtttgttcctaaatattttcatataagaagtgcttttaattaagtaaacggtcattcatggctcaacttctagcatgtacttattttagagtaatttcgttccctccttctgaacaggaattattagcattaggagacagaataggctctgttagcaccgctctttctgaggagcaatttgtgaaatgcctcagaagaagtatatatataccagtggctacaaaagcaaacgcgcaagttgtagacgacatcaaatgcagcatatgccaggtatcttgtcatcatctaagcatcaaatgttgtgttgcaccttttttagggagtctactgctactaatgcatagtgaaagactgaaagtgaaactgaagaccgaatctacgcttccactatcttacattcttatgaaatgaactgttacttcgctcttgccaatttattgaacactatttatgattgattttgcgtcatccctactacttgctgatgattctttttaacatacttgttactacaattaacctacagtgtccacagatgttcagagctcagacaactgttgtatctacttcctctgtttcacattataagatgtttttggtttttgaatagattcatgcatggatccatgtatgtgcttcgtatgtgttcaaatttatatggatgctagtgaatctggacgaggatggagaaaccaaaacgtcttataatatgaaagggatggagtagtactcagttttgtaaaacctgcatctgaaacctccatcacccttccaacaacggcaatcgattctgtgcctgtaaaaaatagccattaaaggattcatcaattggtttgaacataagaaataaaagggattactttggtaaatcgtcacagtaatgggaatatttgtctattccaggaggagtacatagagggtgaagaagttggacggctgggatgtgagcatcagtaccatgtgtgctgcattcaccagtggctcaggcagaagaactggtgtccaatatgcaaagcttcagctgaaccttctactgtgagctaatcccacctgggagattcaagcttgtaaatatttatcatggatttggtgtccatctttttgtggaaactgtaaataatcttgaccttgttcactccaatttgtgattatcaaatcagctgtgctctgaaaacaaaaataatccttcaatgtttctcatggttaaaaaaaaaagcttttctatgtttatgttggggtacctctcccaatgcaggggttgttctagagggtttgagggtggaccacccttgattttggcccaaaaagatcccttcttcatatggcccaaatccactacataaacacggcatactaaactatttatattgtgtatttttgaacttttagactcgagttagttggccctgttcgatctcccgtttgggagatactacaccgtcccagaaaaaagtttgtttgggagacacgtatatgtcctggtttgtaggtaggattggattcttttttggatggaggggtatatttttgttgcacgcaaaacgataaacctcattagcacataattaattaaatattaactattataaatttgaaaaatggatttatttgcttttttaaacaacttctatatagaaacttttttttaaaacaaacgtatcatttaacattttaaaaagcgtgctaacgaaatacgaggaagttgaatttggagttgaagaaatagaattgagcccgtaatgttgcgatattattactgtatttctatcatattttgagcaaattttgtatatgtatattgagtttgcatcattatgtgattttagagtgtgaagtaggaccaccgaacgaaaaaatcctaaagccgtcactgacccgaagtataacttagcggtactgtacatcaaaacatagtaagctgtatacatcaaccttcaacctaaaagattaaacttattagaaagagtaaactctccacttatatttgactttctttttcctagctttttgcactttcgactattctacggaacaaacgctgctttcaattatcaaaatgtataactacgttgtatacaccaaatatagtaagctgtacgcatcaacgttcaatctaaaagattgaaactataagaaagagtaaacactccacttatattcgattagctttggcacttttgactattctacttaacaagtgctgctttcaattgtcgataaaaatgtagccaggcaaactgtacctcccataaatgacacaacagtactatggatgccgagtgacatggtctttctcaagaaatgaaatgatggacaaatgcactcacttctcgagcttttaaaggtacgatttttttattaaaaaaatttctcagaaaattgttttaaatatattttcaaaattataatatttattttattttttataccctcaaataattaccacaaatcacacgttggccttggaatatatactccctccgatccaaaaagattgttactctatgattcaaaatttcattccttcctatctctaactactggtccgctcccaactacacattaattaataagaggatctatagtatttgtttctcgaactttaatctatgctaaacaatttacaatgataatctttttttaaagacggaggagtactatataggagcacgcagctgcaatatgcttgatcacaaaataaagaaaaaacacccaaattaaagtatttgcagtaaatatgtctacatgaaaaaaatatgttattccagctagaaaagccacgcagtttaaacttgagatgactctagtaccatattgagttgcataaacaaatcagttgataattgattgttccaaaattcagtatttgtgatatgtggatctctaattggccgaaacctaaagaggataatttacttatgtttcaacccttcctagcttttgcacctttcaacttttctatcagaaagtactgctttcaaatatcaatcaaaatggaaaaagaaaataaaaagacagaaaggtatgcatcaagctggccaaattgcgcatcctacacattacatatacaatgtatggacggtaagttacatctttggccctggaagatactgaaaatatattggcaaccacagtacactttaaatcataacttggaaaagaagtacccaaattgtccacagtaaccgaaatatctatatgagaaaagtcaccacatgcaagacatgcaaacttttttttctgtcttttccttttgccctctcagtccaatccaaccatatgatggtttgaaaaactctccaaatagttatgaaaaaatcttgaaaaatttactacactcatacaacatatatatctacaaaatcttagctccaaaatcaactcatagattaagatacaggaatgacaaatttagcgtatgaacagtggtaccgttcatacctgaatttgtattatttatttctcaatgtgtcgggttgaattcaaacttatttttttgtgaattaatagatatcactgtactctacgtcatcaattttgtaaagatttttttaaaactatttgtatcaaatttaaaataaaaaggtactccttccgtcaaaaaaaagataacctatgaaggtgtccagatttattgtactaggagggatccctcctaggttgatccctcctaggttgcctttttttttaggacggatggagtacacagtagaacatcctcctcgagagattagaatccattccaatgctgatgattcattggataatcaaatgtttcaatcgtccgttagatttttcctacaatatatctggacaggggacatttctaaattcatagaattatgatatatcatattagtactagattcttactccctacaggctgatactccctccgtttcatattgtaagactttatagcattgcctatattcatgtagaagttaatgaatctaggcatatatatatatatatatatatatatatatatatatatatatatatatatatatatatatatgaatgtgggcaatggtagaaagttttacactgtgaaacggaggaagtaatacttattgttttagataagggtgaggtcaaactatagaatcttttattatgaatcattaatcatttttaaaatatttgtcttttaaatatggtgactacatgtatagagtagtcttaaaaaatactttaataaaatcatatattcgttgacacttttatacatattataatagaaaaaaagttttaaattggttttttttggagaccgtgctctgtccaaaacgataagtattatcaacccggagggaatatattttaggacgaaagcaaataatacttgaaaagaaaggagagttgtcctagctacttctaatggcacaggctttgctttgcaggttcatcgcggacttgctacaagttgccacagctgctcgtgctcaacgtcagtggacagatcacagccgtccacacctcccgcctccgcagatccgacggcccagatctccccaaggcccccacccccaccttcccctccccccctccctcctcccccatcgtccactcgttcgtcgcttgccgcttcgtcttcctcctcccacccacgaattaatcctcctccatttttgctaatcccgacctctctccctcgctaatccgccgcgacgcgcacgcgcgcgcagtacaaatccgcgccgccgacctcgcctcgccgagcttgcgaggtggttccccgttcggcccccggggggcccgccatgggctagggtttgcgggcgatggagtgggacagcgactcggaggggagcggagacgaggaggaggaggaggaggaggaggaggaggagggggttgaggtggggggaggtggggatgggggcgtgggcgtgggagtcggtgggggattcgcgctggcgatcgagggggtgctgggcgcgtgcgggctggtggtgtcggacgcgctggagccggatttccccatcatctacgtcaaccgcggcttcgaggacgccaccgggtaccgcgccgaggaggtgctcgggaggaactggtgcgtctttgtgcgctctgaattttcctgattcaatccttaaatggcatttttccagttccagcctttttgtctgctctgctgttgttgtgattttgatcacatgatatgataggcgggcgataatgacaagttatgtgtttctgcagtgataggaaaatcggtagtaatccacactgaactatcataaattggaaaattgttgttgaattgtcgatttggactacggatatgatgattgcaaactgaatatagtgttgcatacagggcctgtgtacacgattggttttggttgtaaattgcaccatagtagtgggcttagatggaacatgctgaggactccaatgttgtgtcttcatagcgctgagttggtccaccacaccgattggtcatgttagttttgccggagcacgcttcgtatgtctcatatgacagaaatcaccgggaattttggttcagggtcctgatgctatttccttccttagagcatgtgttctggatttgcatcggctatgttagtctgttggatatggtacccataggataggaggggatcccaagtgtataacatgctagcagtcttcacagagatttttttttctctaagtctatgataggtttatcatctgatgctcttgctagtagtgtttatggtcgtagtgcttgttaaactgcttgattttgaaagttggccgaggtagatcgtcagcatgacacattatgtgagtattctgttcttagttgttcaagtgtctatgtgtttcttttcctgcctgtagtagttctgtggtagaatattattatctggctgttcactaggctctttccttttggttgtagatgcctactgtaattccagttttatcagtatttgttattagaagtgcaatttatatttatcatgcatgatgccagttacttaatacatgcaataccacacaagtgatggattaaaataaactgttttctcctgccatttgtactagcaccttagcaaaactggtatccttcccttatggcattaggtggtgtttggatccagggacttaactttagtctctatatttagacactaatttatagtattaaatatagactatttacaaaactaattacataaatgaaagctaatttgcgagataatttttttaagcctaattaatccataattagagaatatttactgtagcatcacataggctaatcatggattaattaggctcaatagattcgtctcgcgaatcagtctaagattatggatgggttttattaatagtctacgtttaatatttataattagtgtccaaacatacgatgtgatagggacttaaaagttttagtcccatctaaacagggtctaataggttctgtttcgaatgtagattttttttccaaatctcataggagtcaaatggattcatgcgaaatggcaaaaattattcctggtgatgttataaattgatttctctatagacaaatagggaatgccagattgaggttccatgttctatctgtggacctggggttggatgaatatggagaaattgtagatgaaaggaaacatgaccttataatttcatgagtatatataagctagattcttacaaattccagagtacgcctatgtggagtaggctgacctttgtgcatgttttcgtgcgctgaatcatgcttgagcgctaatttaactgaacttatagtggccttcattatcatgatttatgaggtagcagttaaggcacaactgcacaagatgacctttagcattactggaacagttggatcatatatcaaggcacttggggaattcctgattagaactccatcattatgactcaaaaatataaaaaaaaatatgtgaacagtgaacatgctctctcaattgctagtgatagaaaaatatgttttatccttggtccttgctgatatgattcacctaatgcagttcctcaaagccttttttgagctaccctgcaaattagttccaatatccttgctggtgtgattcacctcataagcattttttttgggcttttagcaaccttgcaaattaattcacatgctatgttagttcttgtatatcttatttgtattgctaacaattgttgtgtgctgttttcctcagtcgattcttgcagtgtagaggaccatttgctaagaggagacatccccttgttgatactacagtagttactgacattcggagatgcttagaggaaggcactgtgttccagggcgatctgctgaactttaggaaagatggttctccattcatggcaaagctccagttaacacccatttatggagatgacgaaacaataacccactatatgggcatgcagttcttcaatgactctaatgttgatttggggccattgtctgtctctacaacaaaggagattgtgagatctactttgattacaccagataacaccatccgaccaagtccaatggggaagggcttctgctcagagcattctgatcttttcctattgagtgatgaggtactttgccagaagatcctatcaagattatcgcccagggatatagcatctgtaaactctgtatgtaaacggctgtaccacttaacaaggaatgacgacctttggagaatggtttgtcagaatgcatggggcagtgaagcaactcaagttcttgagactgtggctggaacaagaagtttggcatgggggcggttagcaagagagttgaccaccctggaagctgtcacctggaggaaattgactgttgggggtgcagtggagccttctcgctgcaacttcagcgcttgtgcggcagggaaccgtgttgtcctttttggaggggaaggtgttaacatgcagccaatgaatgatacatttgtgcttgatttgaatgccagcaagccagaatggaggcacatcaatgtgagatcggctcctcctgggcgctggggtcataccctttcttgcctaaatggatcacggttggttttgtttggtggttgtggaaggcagggcctgctcaatgatgtgttcatgttggatttggatgcacagcaaccaacttggcgtgagattcctggccttgcaccaccagttccacggtcatggcatagttcttgcacattggatggaacaaaattggtggtatctggtggctgtgctgattctggtgtgcttctcagtgacacgtatcttttggatgtaacaatggaaagacctgtttggagggagatacctgcatcttggactccaccttgtagattggggcactcgctctctgtctacgatggcaggaaaatcctgatgtttggtggtcttgctaaaagcggtcctctacgactaaggtctaatgatgtgttcacattggatttaagtgaaaataagccatgctggcggtgtatcaccggcagtggaatgccaggagccagtaatccagctggagttggtccaccccctcgccttgaccatgtcgctgtgagccttcctggagggagaattttgatatttggtggatcagtggcaggtcttcactccgcttcaaagctttacctgctggatccgactgaagagaagcctacctggaggatactgaatgttcctggccgccctccgcgatttgcctggggccacagtacctgtgttgtgggaggtacaaaggcgatagttcttggaggacaaactggagaggagtggacactaactgaactgcatgagctttctctggtaagctctttagtctgaggatggaagtcaagtccccagcaggcttccagcttcattgaagtgatgatgtatacagagagaagctattgttttcatttgaccgaagcctggacattttcaccgttgaagccacacagaaacacaattgaaatgtgcaagcaaagtgagttattctccttggaagggtagtttgtgtttggttggaaagagatgatgactagtctcaagtagtagatccacttatctggttactcaccgcttctctgcgtcgctatttgtttggcctactacaaaataatagataataattatcacccataacctaataattatctgtttgttctcatcagatgtttcctacactcaaccaaaaggatctggaattgtatagttggaagctctgatgcaatgcaacaagcatgctcttcaaaggccaaaatgatagtgatgatgctgtactgatccaatatttctgataaattgttcgatcttttgttgaacatgcaaaactgttcgattagttgtacaccatttttttttctctggcaatacatttagtgtcaattaccaaaggacaccatatctgcagaaatcacccccccccccctctttctctctcctctctcacatgtgttgtatgtttaatctttaaacattgtgatgacaatgtctgttcacatagaccacacggttatacttttgtaactttgattgtagctgaaagcacctggattgatcattggaaaacatggagattttgcttccatacaaacatctgtcttttgcagcaattaaacattaatatgccaatgtttatggagattttgctgatatcctgaaatgtcaacatatgttcacatgtttttgggtcttaattttccttacctatgattgacaaagacggtaagaactaaataaagattaagatgcacatcctgaacaaggcaggcatcttaaagccattgacgcaaccctaatggaagtcaaccagaatcaagtagataagccaaagaagcaaccagcattctgacaacattagcagttcttatcctgcacgaaaaagctctgaaaacccagcaaaacaacggttagatgatttagcacgaatgctttctgccattcgcgagaagaacagcctaagcaacaagcaacattttaactaatcaaaatcatttacaaatctcagcacactccaacacgaaatcttctctacaaaaccagcatcagaagcaaagcgtcaatcaggctgttcctgtcatgcgtatgcttctcacaatccaacacacttgtgtcaccatgtgaaacatcagcaaaattctgaattttccgacaattatcgtgttagagagatagcagagagaacaaattgacttggcaaatttgtgagcttttcctgtaaaagtttggtgtatttccagagaaacatttttaagataaaatggattcccggagagaaaccttggatcaacattgctatagggtagtggttacatatttacataggaacctaagatgttgaaacctgctgtaaatgaacaacaatgaagggtttgctgctatcttatatgcacaccaaatttgggctgggatagcatcttccagatttttgagagaacaagaaaaagaggcgggtagaggcacaatattctggttgtggctgcactgcattacatttcagctggctggttcatcctagtagtatgaacgtctgcgtccatatctaggatccctgcaaagatcaataatagtagaaggcgcatcagaaagtgtcgagctcaaacaagagttgtgttaattgtgctggcttttcaaagtacacactcaagacttctctcaagagttgaaaatagagttttcctagtgattgtctcatgccctatgcctattttcctagtgagaaaataaactttttctcaaggaagaatgtcaaacaaaactctgcctattttcgcatcttatcatttggtgtcgacatgcgtattcatgcgttcatatcagctttcggctacggtcaagtcttttgagagctgaagtgtatgtccttttggcaatataacctcttaatagcaacagaaagcaagaaaaataaaattatatgcacacacctgtaatgactggcgatcctcctggatgctgcaatgccgggcattgctcctgtaactatatattcatcatctatttcatcaaatctgatttcccttatgtcaacagatcccgagggcacctcaatagtaaagctttcttggctagacctattgctgctcctccttccactacttctcctttcccttgctcttgctctacttctgcctcctgaagatctgcagaatgacttacagaaaatacaggatgtccaccagttccccctaaccctgtggtaaacttcatagtcatctccggcatcatcatcaccgtactcgatgacatagtctcccaaaactataccattaggcacctgtgcatgtatcgtgctcaagacatctatgatatctgaagactgttggaaattctcccaatcaactctccgagcaggatcaatttctgacgggcgtgaatttggatgcttctgctgggtgtgcttctgaagctcatgaaagttgcccacatatgaacaacagctttcttcgcagcatcttttcttttggttaagatgcagacgggcctcgtcaataacaacccacccaataacatcgcctctacacaacgggcaagctgggcggtcagttgtatttgacgaaatgatatgaatgctatcaagaggggctccattaaaagatgggactttcatattggtcggcagtccatgagcacctttgaaccgctcaagacagttcgaacgggattggtcagtgtcgcatatgaacggcctacaacccttctcatatgaggtgcacctcaataggacagcattatgaggaaaatccagacagattggacaagtgatatcctccatccaacttttatcaagtttggcatccaaatcgaaagaaccggccttcaccaccttcttcttcaccattcctgaacccatactgaacttccaagatgcaggtctgatgctaccgagagtatcttctaacgaaaacctgcataccacaatcaacaaatcgatttaggctcatagtaccataagttagatcacatcatacagattttccgtaagcaagtaaagcaacaagactttggcattcccatcattataaagaaaaaaaatcatcatgagcttaagaactaagacattagtacattacaacctttccagatcagcaaagttaaggaaaaatagatacagttccaattaattgtcctcgcatctagtgtcctacttgaacaagtaatgatcagctattgttgtcaagtgaacaggtcttagtttgcagcacaaaatgatgcaaaatcacatcaatgtcaactagcttcctaacactttcatatcatgtgcttaagaagtacccttgagaggtaccgctttaatagagcaatcaagcacagtcaaaattcaatgaaggaaaacaaagccatcccatgagtacaaatttatcaacctttttctgatttcacctcaattccaaaaacactactgctttatccaattgcaaacacaacaacacacagttttcacctaaacaacaacagcaaagaatcttcataaggcatgattaatcaggtgtagcagtaataatcaggtttgtttcttgatcctaaaccatagctggaacgaatttgggtggcctaaactaatcaaaatcggcgccgaaagctagaaaccaaccaaaacccaaagactgaacacatccaaatccagcacataaacacaaacaaacaaaaaataaaaacaaatcagcacagaatcacctccccctctcacaccacatgtccccaaaccttttaaattaaagctgagcaaagaactaaactaaagaagaagagagacaactctgaagcaaagcacatcacatgctgcaccacaacccaaaaaacaaaaaagaggaatcactccgaatcaaccccctccaacacaagaacaactcacagatcggctcagacccgcagaacccatcaccacaaaaccgcacaggaaatcatcaaatcaaaacaacaaccaagaaaacgaaaagaaagaatcacatcaacaagaagagaagagagacgcaccgcagcagcagcagcagcagcgacctcgggggtaggtgggtggcgccgtggcggagagaagagaagagaagagaggagaggagaggagagatgacgaagaggagacaagcctactactactactaccctagagatgggacctagacgcctactactcgccctcctctcctctcctcacctcaccacttctccgcctctctttctctcgagctcatgcgctcgcttccgcctcctgagctgctagtttattctttcttcttcttcttctattgggattgtactaccaccaccaccaccactactcgccgtggtacgagtataaaaaattccagctttttttcctcgctgccgtgagcaaagcggataaaaaaccgaactttttttttctttgtgggtgtttctttggatgtttgggaattgggatgagagagagagagaaaactcgcgatcggcggtggagagagaaagatgaagcagcactactactgactcggctccaaagttaacgtccagtactctctctctctctctcttcctcctcttttcatcttgtccttttcaacgctttaattgtcttctctttttttttttgccttgtgatgattccaaaagaaaagaaactccattttgttttaatttatgaaatattttcaaatatccccttacaggatggagtaatttatccaaaaattgcagaaatttatgtagttctatatgaagtttacaaactgttatcttcgttttagaatgtaaggatttttagaatttaatttgtataccataatataagcattttagcattgattcttgtgaatttcattatttcaatagtcccatagccaataggaaaaataatctaagcaatttaaaaattaaaaattgataattgaaaggtttaaaataatcttttgatccaaccttagtccttaggaaacaatctaaaatatgaatatatttagggaaagataaagtagaaaataggggtttgaattggaatggaattatggaggattccctggtttcatggctggtgaggttggtgattcaacgtccctttaaattgttgataacatttcaactaccggagacaaaacattcatttatcataacacagtgtacgattacgcagtagtaaaaagtatagtagtagtattgattatgcatgtgttagatggtattcgctgcagtactacgtcagaatttacatatatatatatatataattcggcagatgaacacatcaggtttcagatcaacaaaacaaggaaagaagaaaaaaaacacaagtactatcacttaagagttgtgcaaatgattagtttctgctacttaactaaaccaaaatggcactatttaattcgtctcgtggcttccactcagatttgtttaaatgcggaggtcaagatgattgtctcccattggatgggcatttacattaattaattaacacaaaatactattcaatccacaaatatatacttgtcgtattaataacgacatagacttctgagtgacatttcactagtctcgattgttttttttttgaaagaaccattaaaatatcatatcgtgtatatacttttctggataagtcctcatatatttttttgtggatgcaatctaaataatttcaaaaaaaatgtttatgccaaagttatgataggaagtatgcataaagcaactagtatttgtgaccagaaagaatatgcatctggctacctgatctttcaatggaatttcttatagtttgagcacgaaattggtacaaatatatcaatattagagccacttgagcggttttgtcaaaaaaagaattagtcacttaagtaaaattcccaacttccttccagaaatgcactgtagtatttattgtgtgcgttgtgatgcttttttttttcccttctagaaagtagatgcaacgacatgcactttcggtaacctgggtcattagccccacattttcttttctttcagttaaattgtaatgtgccataaagacaaagaataaaaaaaggtaaagaaaaggaaagttaattaaaaaaggacggttggcttgtgtggaaagagtaaaaaatatgtcagcacagcagattgaggcactgtttgtttaggcttataagcaacttataagtcaaaaagtctaagccaaaacaaaacaatcagcttttttatttggcttttttgaaaccataagccactctaacactattaagccaaaagttaggttggagaagttttttttggcttgtataagatagatgtatgactccaccactaaacttagaacattaaattcactggcttataaattatataagccaataagctaacttaaaagtctagatcaataagcctaaacgtaaataaagagggcttgattattgcaaggctaagcaaaagcttaacagacgggttgtttattgcatctactgcgatatgatcttcacaagtggtgaatttttttcagtctagtttagtagctatctaatgcttctctgcattttgaaaaaagtaaaatcatgtgcagtttaatcctttggcttattaaaaaataatttatgagcaatcattagtgatttaaaaaccaatgctacaaaataaacttagataaaaaaaacctttaaatcaaaattaaaattaagttttaaaatttaaattttaactgcggttgataagctaaacggaaaggatggtcctcgggttagattcagtttggtgtccatccaattaacctgatgcagcttaaatcaacatttagtaattttgtgaaaagaaaatgtgttcctacataagtaaatttaaattacagttagtttactgcactcatgtgagcaattaacaaaatgtataaatgcacgttttttaagttgacaaaatgtgcattcatagttgtcacgtgacacacgcatggggccggggtgttttgagttttgacccatgcatgtaagccttgcgccattaattgcgagtgcatgattagctcttccaaccattttttttaattttctcaggaatcaacggaaggaaagagcaaaaatcaaaaaggatttttccttgtttagttctaatttcttgtttctattttccatttcagttgttcatgaattataattataataaaatatgtacacacagtgcttcctctcatattattttaattatgattcccaatgtattaaaaatattaattattttggcttatcaattgattagttaaactagcctttctcatccagattcaattatatttgtgtggttctgttttaaaaactgcacacctcataaagataggagatcaccatcatcgtttggctggcaccggcagtgtacgtgccgacgtgttgtcttgaatcacaaataattaaagatttaaactgatttcatcaattaatcatttactaatttaatttcagaccatgccaaggttggtacacgtccaccgatcaatcaacccaacccagagagatcgagcttacacgtttctcgaacacgcacgcgtgcacacacgtgtcaagcatgcctaattgtatgcggtagaaaattgttttttttttgggtgtgcagataaagattttctttctgacagttcatataggaaagtgaaggatttttctggttaagtatataggatgttgttagattcagattaggagatggcaaatgcgaaacataattgttaacatcactagtagtatcatgcaactgattaattgcatgtttgtaaatttaatgttgcctgttgcgtgcaaggaatggattggaaaggagattactccaagatttgatgttaatttgattatggagtactagtatgtcattagcaagatcataaagaagagacacctctaattaatcctctttgtatgcttaatagtactgcatgcacaatgccatacaatcattaaatagacggttcagagcaagaaaaaggaacatatatacgaatccagaacacaattactgattgatatttatcaattgaggtggcagatctgatcaaaaccttagaaatagtttaacaaagatattacttaaatgtgctgcttacatactctggatttttctttgcataggctcatatttaatatcgaacaaaatcctccggtgggattggtttaacgtgggtgctaatggggaagctaccctgctggatcacattgataaaagaagagaggcgaaaaaacaaagagaggaagaggagaaatgactcgagaggaagaagaagatgattccctataatggttttttttttatccgtccctactcctcgcaccttaaaaatatttttggaggagggaacgtaaaatcctctagccggtaaaaaaacaaattataaaacgttttctatgtaattgctaaaaatccttaagattcgtactccctcttttatattacacaaagttgtttttttaagttaaacttttgataagattgtagaaaaaaatagcatcattctcaatacaaaacaaatacattataaaaatgtattcactaatgatttaataaaattaatttagtgttgtttctataaatttagtcaaatactaatgaaataacttaagacaaacctaaagcatcttgtaatatagaatggtgggagcaatataaattaaaatattttacaggaatttcatagaaacccatttcttcgttctgaaagatctgttccatttctccttgttgcatcagtaactccaaaccaggtcattagttacagcgtctgccaagagacgtcggtgcctccatctcggcccagcccaatagcccatgtcatagtcattctcttaaatgggcctgaaatttatccggcccatatccataaatgggctgaaatctcagcccggcccgaagtaggcctcagtacgatttttccaagacgagcaacgaaaaaaaaaagaaaattcacgcttttaccaccaccatctccggcgatccggagcaggggcgatggcggcgcggggctgagctccagcggcttctccggctcggaggcgcgggtgcccccccagagacagtctccaccactctctctctctctctctctctctctctctctctcctacagttggtggcgcgcgaatggcttgccgcctgcttctccgccgctgcctctcagccgcggccgcctcgtcggcggcggcgcggttcgccgtgaggcacgcccacggggagcttgaagtgagcggatgcagcgcccgcatccgcgatctcggccgcctcggccgcgtgggggaggccagggaggtgttcgacgcgatgccgcgccgggacatcatcgcctggaactccatgatctctgcctactgccacaacgggatgcccgacgccgcgagggacctctacgacgccatctccggcgggaacatgcgcacgggcgccatcctcctgtcgggctacggccgcctcggccgcgtgctcgaggctcgcagggtgttcgatggaatgctcgagcggaacaccgtggcgtggaacgccatgatcagctgctatgtccagaacggggatatcactatggcacgaaggctgttcgatgcaatgccgagcagagatgtctcatcatggaactcgatgcttactgggtattgccacagtctacagatggtggatgcaaggaatctgtttgagaaaatgccagagcgcaatttggtttcgtggacagtaatgatttctgggtacggtcgaatcgagaaccatgggaaggcttgggacatcttctgtaagatgcaccgtgaaggactgctaccagaccagtccaattttgcctctgcgctctcagcagttaagggtcttggaaaccttgatgttctagagagcctccgtgttcttgccctcaagacaggctttgagagggatgtggtcatcggcacagcaatactaaatgtgtattcaagggacacgagtgtgcttgacactgcaataaaattctttgagagtatgattgaaaggaatgagtacacatggtcaaccatgattgcagctttatctcatggaggccgaatagatgctgctattgctgtctatgaaagagaccctgtaaaatcaattgcttgtcggactgcacttatcacaggccttgctcaatgtggtaggattgatgatgcacggattttatttgaacagattccagaacctattgttgtgtcctggaacgccctgattactgggtacatgcagaatggaatggttaatgaggcaaaggagttgtttgataagatgccttttcggaacacaatatcttgggctgggatgattgcggggtatgcacaaaatgggagaagtgaagaagctctgggtttacttcaagagctccataggagtgggatgttgcctagcctatctagtttgactagtatcttctttgcttgttcaaatattgtggcacttgagacaggaacacaagtgcattcccttgcagtaaaggttggttgccagttcaatagctttgcatgtaatgcactcattactatgtatggcaagtgcagaaacatggagtacgcaagacaagtattcagccgaatggtaactaaggatattgtgtcatggaactctttccttgctgcacttgtgcagaatgatctgttggatgaggccagaaacacatttgacaatatgctcagtcgggacgatgtttcttggactaccataatatctgcgtatgcacatgctgagcaatccaatgaggccatgggggctttcaaaacaatgttttgtgaacatgagttacccaactcaccaattttaactatacttcttggtgtatgtgggagtctaggtgcttctaagattgggcagcaaatccacactgtagctattaaacttggaatggattcagaacttatagtagccaatgctctcatatcaatgtatttcaagtgtggctgtgcagattctcgtaggatttttgatctaatggaggagcgagatatttttacatggaataccatcattacgggttatgcacaacatgggcttggaagagaagccatcaagatgtatcaacatatggaatctgctggggtgttaccgaatgaggttacctttgtggggcttttaaatgcatgcagccacgctggtttggtagatgaaggatggaagtttttcaagtcaatgagccaagattatggactaactcctctgccggaacactatgcttgcatggttgacctgcttgggcgaacaggtgatgtgcaaggagcggaacaatttatttatgatatgcccattgagccagatacagtgatttggagtgctcttcttggggcatgcaagattcacaagaatgcagaaattggtaaaagagctgctgagaaactcttcagaattgagccatcgaatgctggcaactatgttatgttgtcaaatatatattcttccctagggatgtggggtgaagttgcagaggtacgaaaaattatgaagcaacaaggtgtgataaaagagcctggttgcagctggacacagataaaagacaaaatgcactcctttgtcactggcgataagcagcatgagcagattgaagagatagttgctaccctcgaagaactgtacactttgttaaaggctacaggctatgtgcctgacacagaatttgttctccatgacattgatgaagagcagaaggagagctcccttttgtaccacagtgagaagcttgctgttgcttattgccttcttgctacacctaagggcatgcctatacagatactgaagaaccttagaatatgtggtgactgtcatacttttatcaagtttgtatctcatgtcaccaagagacaaattgacattagggatggaaatcggttccatcattttaggaacggtagctgctcctgtgaagatttttggtgatatattttgacttcagatgtgatattggcatattgccacttcagatgtttttattgagttgtagaatacagagcagattgcattttgggtgcaatgttcaaatggtgaacagttcgccatgagccctggtattcctgccattgccattctccacgtcacaacatgaatcgacacctggtgagtgcctaacatatttggctatctagtttgcttttcaggtagtgaatctctcttgaacagacaacttttaaatcaaggtccaatgaaatgttaatttatgttggcactgtgatgttttagtcaacagttaatgtactagcagctatctctgctacctcttacaggtggctcagaagaacagccagctaatagctcaccttgtatgagatatactcatcatagggtaggatatttggtcactaactttacttgttgaaatacatcaaccgacaaaaacatttgttggtgactctgaaccttgttcggtctattttgagtcagatgaaatgaaagcatgcattgtaacttctggagacctttgcctggagcctaacactcgtcagagtttgtggcttttcagacatgtactacgccaatagattcctgggatacaggtttgtgctcgcttctaaaatggcaatgtgttacactgataaatactaggttaatgctacaattgaatttttcagacgtattaaatctttttttcctctaaaattattatcttttgttcaaaaaggatgtccaacttacttaaggttttatattattttcagagcttatcaagaatttcatcttaaaagaactaatatgcatgctgaccgtatatgtgttgttcttaccacgattccagatcttctctcatgacatgtgactactaatgatataagggatacactgagatggttacggtgaaaaaaagaaaaagaaaatgttgacaacattcaggatcgtagagttaatcaggtaatgatgattgtttaagttgtaccattgtgatatacagctgttttgattgcgcatggacttgtatgcttgtacagttgtacaccatgtcagatcagagctgtaggagatttgaacacgagattgcagagtcatatggtgcaggccaatgagtggatgaagaccccgacaaatgataagtatgtttcagaatttcctttgtcattgaagatactgagttgatgtaggttgtcacagcctcacaggggagttggtttgtgatagtgttgtaatttgtgagctggtatacccagcattttctttttggttttgtaagatcacaaaacctatattttgcttccagttaagcaagagcatgacttttattaaaaaaaaacagagagagagaggaagcgatggaagggtgttgactgcgtgtgttggtacatccaggtattatagacaagtttgcatgcttagaattagttgataggtgagttgttatatataggataaaattgctgagttgacaattttaagcagatgcatcagtcctgcgtttgtttaaatgttgttgacagttgcgtgcacgggatgaatgaattagaagcttactcaaaggtttgatgtttaattggattgcgtactgcatcaagcaatttacacaaggacagcctctaattaatatatcttacaccaaaaacttcaaaatccggacaccatcaccacatcaagcgaaatggatggtcatagaaagtagaaacaaagaaaagaaaaagaaaatgaactggagcaaatgaaagtttcatttcaagtttcacaactacaactacgaaatcgacacaaacctaagttttttttgaagataaacagtagaaaatttatatatgtaagatcgaacctccatttcgcatgtaagatggaagctgtcatcttactgcaggcccaggagaaactcttgatatctccccagattgctcttctacctcaagtgcagtctcctctccaagattgctcacgctcacgtcatcatcaccagtcaccaagtgcttcctatcgccatggctctcgagctccaagctctccttaagctgtgccaccacctctgtcatcgtaggccgctccctggagacctctcgcttgcaatgcagcgccaagtcagcgactttccagaccgagttgatgtcgtagcctccccctcctcccatccttgcatccacaatgctctcgatgctgccgtggtcgaggctctgatgcacaaactcaccaatgtggatgctcacgctctcgtcgatggggatgacgggagggcggcctgtgatcagctccaggaggacgacaccgaagctgtacacgtcgctcttctcgctgatatgataattgcggtagtacctgaacaagatgggcagaatatgacatggaagttcagttacttggtagaactgaagatatttcattttgaaagaaaaacaatgcgattgttcacgcgcaatattgaaaaggaaagttcagtatacgagagttagaggagttactcaggatccaagtagccgaatgtaccagctggttcagtggtcatatgtgttctcgattcactgaataccttggtcagtccaaaatcagcgatcttagctccaagatttgtggtcaagaggatgttcctactcttcacgtccctgtgaatcagtgctggcttacacgcgacatgcagatactccaatcctgagatacacagatattaaacttttattaggtaataaactaataatgcgcgggtatgaatgaaatatcagaaaactaatagtagtattttgccgggtgaaaattaatagtagtagctagttaagttttaaccttgtgcagcatcaagggcgatgtgaagacgctgctcccaagtgagtggcttattagtagtagcttcacatatcaacagaaaatgaacataatcagtttattgcagattttggagaaatccatggaaatgatactttctaatatatctatgtggttttcatttagcaaccgtggctgttcttgtgtctttgcaattctcctttgagaaaaatgtaggattactctataatctgattctaaagatataacagacagctaatctccctccattcaggcctcagaacaacttatgttcgtataattgtatttatattagccattaacagtattttcatgataaaccaactttatcttttactagcatgacacaaacaaagggtcaaagctctacataagcatctatatttggataataagatggataacctctcagatgatcctgaaggttcccttccggcatgtactcatacacaagggccaaatgatttttgtccttgcaataaccaatcaaggaaaccaaattcttgtgatgaatccttgtcaaatgttgggcctgaaatataaaattcagaaaattcaagcatagcagatatgagagtgattagtaagtagcataatttatctacaaaaccaccaaatattgaaattgttcgttcatcagaattcagaaacagatggttacacagaaaaaacatgtgtaaggaaaacaaactgcatttttgacagtatattgtagacaaaatggtacgagttatgaaagagctgtgatacatacaacttctccaaattaaaaattactaatacctcagctagaaactctttacccccctgtgaagatgactcggatcgcactttcacagcaactgggttaccattttccaagtaaccaaggaacacagctccaaacccacccttaccaacctgctggctaaagttattcgtaatatgcttcagttctctgtaagagaattctctgttctcaagtaatgctgattcatatgtaggaccagcagctcttctcttgtctgacatgtcagtaacacattttagcaaatatcaggaacatagttaaatgcaagaaatgctattgttagaacaaggcaagaaaaacagcaaacaatctgtaatgcactaagcagatatctcctactgtcctcctgactttattaccttttgccttgagcattcggcgcagaagaagaaataagacaacaattagtgcaacagtggcaactattgtaataattattgcagaaagaagtgaccctttaattttcttttgacctgatccgcattcagtatcgttgccacatagttttgcattataaccaaccctgacagtatcaaaagaaagcagtgattgtcattaggaatatgcttccatggtattcaaaatgaagagagtatgctcaattgaaaaggctatagaagaaaactttttctctatatacgtaaatcagatctaactattaactaggttaatactgaacctttttagagttccttcaacaacaaattgtccaggaaaaaaactaaagtacccttaaaattattgggaaagagtaaattgatatctgaaatctttccatgctttcctactacatttgagaaagtgaagcatgaccatggattttcttttactgcttcattgccaaaaatattatactaaaagtaattcaaataaactgaactattgaagaacatagaaagccaaataatagaataatcaaactgagtcacccccggcctctgcataaaatgcacacagccaaaaaagaataaatttatagaataaattgaaaaaataatatatgattttaattgttaagtactttcgtaattaactgcatccttcaatcacgttgaaagtttaagtaataaagttattatggaatattttcttcaaagcataatttaagttcagttatccgtgcattctatatttttgtaacatagaacataccttagtgacaaagaaccattttgtgatttttgaagaagattgtaaggaattggtccactgagatcattgctggacaggtccctacaaaggaaaaatatctcatgatataccaaaaaagaaagactattatgtcagaattccaaaatcaaaacaataaaacttacagaaacattagtaacggaagctgccctagaaaatttggaattggtccagacaagttgttgtgtgacaaatccctggaataagtaacaatacttgtgtattatatctagaaaggaataaagaaattcaatgtttcagaaatgctatttatcagacttcatcatgacaggatacagaaaaatatgcaactattcattgcgtgtaaacaataaaacttctctatttcaccaggttaactctgtcaatatatatcgccaaacaagagcactattgaagtatcatttcccgactacatggacaaacaagcaattctctccttttttttgttgaaaaatatgcagtacatacaattctttcaagagaaatactgtgatctactgtgaagtgtgaactcgaaaaatccaaaaagacagtccctaaacaaccgtgtatttttttaacatattgatgagtaattgggctccatatgtaacactcccaatcatcttaggaatatatgcccaatgagtccttaatcctcatgtgttggaattttgctaatagttttgcaaattccttggtaaatactaaatacacaattcagtttcaacaagaaatgagtgttttatttttgattagagcaatcactagtacttcaaaaacaaagaaatcggggacactacataattcattatgaaggattgcggtgcattaaaagttctgttatgagacgtgatggtgagaacctacaggtactggagtgatttgagatctccaaaataagtagcaatagatccagccaacccactggaagacaagtttctgtccaaataaaaataataatcaagaacaattagttctcctattgaaatgttgtaaggtgaataccaaaatatgccacctatagcaatggatattctttatctttcaaacatgaccatgaaacttacagtgatgttattttagaggaatcagctggaggataggaacagtttaatccttcccatgcaaaagcttttggagcacatggatcgcccatccagtttttcttcacatcataattttgttggacttccatcatggctctagctggtttgcaagaacaaggaaatgatcaagctcatacgaaatgaacaatcagcaaagaaaacttttgagatactattgcatgtcaaatgtgataaacaaaagctgtagcattgtcagtgtactacctcttatggtgcaaattgcatgtgaagttaaaatataatagaatttgatgataatgaacataaaattgcgccagtaaattcataccgtctctaggatcagttgcaaactcagttagcggtttcaccaagtacatctccatggcattgaggataggtggaagagttgcatttttcgtagcaacaagtgagacactataacttgccagcccctgtacggtgccagacaaggaatcggcaaataggaatggtggagtataaggttgtgtgttccatgtattgttattgacaataatatcaaactgtctcagcccattgctcggtacagactgtaactcggagaagtagagcacaaagaagtatttggagctgatgttcaccgatgggtcagatggatcccaagtgaaattaattctcgagctattaactgttgctgcactttgcatgacagctgatggtacatcatagacatcagtgaggtaattctgaactactgatgttgcagatatctcagtccagtctgggatcgtatcatatgttgaccaaagccggtcgtggggatcaagtgggtatctgtttggacaaaagaaaaattatttgtgtgatctagtatactagttcactgaatttagtcaaaacgaccatactatcgttgaaaagtaaagcttaaagaaacacaattcatgcaaggtgtgactaaaactgatacatctgcattagttcatagagatatttcaacaagtccgcaagatacccagccatcataggtactcccaaatgttggcaatatttcagtttttaaccaagatggtaagagaaccaacttggttagttaaattcaaatcagagttcagacagaacaaaatctaaaactaacctggttattgaattgtctgtgggtcccatgttgaaccgattggaattgatcagcaccaaagattgagttgtatttgcctctgggtaaagagtactcttcagtggcctcaaatcaagcccagatataaacggagttcccgtccctttgttcaccaaacagacttgcaggtaatcagcaggagccacaactatgatgtccatccaattaactgcatcggcattactaaacttaacctcatgccagtagtttgcccccaggtacagatcaaagacaggaagcttgttcaggctatcgtaatttgcatagtagaagacagctcgaacaaagtacttgtttccctcctgcaaggacctcagggtgtagcagttccgtgtgccatctggaaagaatcggacattgtaattgcgctgtgccagtgatggtttaatgtatgctgaggagatgttatggtttgctcctgtgctgatgaaaccatagtccgaaacatatattatacttgatgtgggatcttgataggacgatttctctggaatgccgcaatcgatgcttatgaaacctggatagaaaacaccaatccaaaattctcagtaaatccaccatgatcaagaaacatacctctgaatgatacatgtgaacattgtgagtccgcagttgctttccattgtgtactgcctgaacataaagagttgaacaaattaggagcagcacaccttgactatcaggctggccatggacaaattgcaagatgtagaacaggagaattgccgcacatatgttcatccttcctgctcactcttgtgaacataactgcataaccagagcactgaagctaacagaaggacagagactatgcatatatatccatgggactaactgatgcattcatattatactcaggtgtcctactctgctatttttataggtagtcaaggtacaagaaaccactaggtcaactacgatacaataaacaaattacttgacatgctacttaattatgccacgctgatagaaaggatgcagatatgacaattttcttgaaacctttgtaattatgtgaatgtcttgtttacattatttgaaggctgtctcattatctgttcactgggtttcaactctcatgatcgttattaacacaatggaatggacctggcccacctggcacggttattattagaattggcaacaaatctagggaaatcatccaaaaaaatagctaaaagaaaagaaaaggcatagcatctagttaactattaagctagagcttctccagagtggaactgacctgaacctgagcaaaaactaattccattccaagtccaactcagctcttgacactccataactttaattttctccccataatattcaatgttatcttgcaatgcatacatagctagctagtcaccatctatcatcaacctagtaagtaatctcatacaataaactaacgagacgatcctgacgaatcttacaagtggcacatcgaggaaaaaacaaggaaaaactagccactataattgctaggtacgagtttacaaattacaaattccccaattaataaacgagcgatgaaccctggcaattctaccaaaaatttcataatcctttaacaacatccatgtccacgacaacttctgaatccaaaggaaacgacgtgagctgcgcagttggagccttcccccagcaacattgttcaggcgatatcgatccacaaggtgcggaaattgcgtacctgaacctgacgaaggcgacgacgcgcgcggcgacttcggggacccagcgcagccgctcaggggcccgtcgcgtcgcgtggctgggggcgtcccccttccacctccgacgacgtcgaggcatcgaagtcggcgctcagatgaggccgctggccggagacggccagtaatgaccatccagttgacggaattcgtcgaggagtggccagaaatctctactctccttgaactcggccgcagactcctgcgcgggcgccgtctccggcgccgacacgagggtgtcgagctctctcgagcgacgcgcacggcggcgagcgccggagcgggcagaggagggcggcgctggcgccggcatttcgccgaacacggcgcgggtggactgtgtgatcagtggagaagttgaaattgagatggagaaaccgaaggggagcaatttgggccttccaggattgggctcaagcccaagcccaagaaataatggtagaacagagcccaaatcatctcaaatcgtacagcccatttcaaacataaaacttgtgaaacccaacattttttttaaaaaaaaacagacaataagtgaaatgcaacagaacattaaattgagcaattgatcaagcagatgatgggagtagatatatcggtatgatttttttttgttctttttttcctttttcattcctttaatccctacatcttctatgttcaaatttcaaaacatgaaaaaaaaaccctctacgaatcatataaacaaaaacgaatgtataaaatttcccttttttcattttttttattattatcaccattcaccaatcagagggggtcatataaattctctcatctcctaacttatacaacatctactacagatcatcctccgccaccggcgacgtcgacgacggcggcgcgtcttccccgcgccgccgccgctcgagctccatgagcctggagaagacgccgaccatgggcgccgtgttgtacgtgcaggcctccgtctgcatgtacgcgccgcggtggtcggtgaacacgtcgttgccgttgggcccgccgacgacggcgccgacgaggtcgtgcgggttctccgccgccgcgctgtaccacgagtcgaacccctggaggcacccgatgaagtcgcggtcgcgcgcgtacgacgcgctcgacgccgcgcggtggtgcacccgccgcgggtacgcctcgccgtacccgacgaggtagctcgtcgccatcgggttcgtccccagtatgtaatccgcctgcgacctcgcgaactccagcacctcgccggcgtccgccgccgcaggagcggcctcgtcggcggcggcgtcggggtccgggcagaggagggggagggagaggtaggagaggacgtcggagtagacggtgaggaggaaggcggcgttggagacgtactggaggttgttccacgggcggatgaagaggaggcccgccggagtgcggccggcgttgtgggcggcgccgccggggttgcggcccatgcaggagcacacgtagtactccgcctttgacctgtacttctccagcacctcgcgctgctgcgagctcagatgcttctcctctaccagcagctgctctccaatatccatccatgcattatcacaaaattattgttaataattattactgcctgattaaatatgatcaatatatgcgaaatagattaaattctcgtgagcaaattaaaaacttattagaaagagctcaaataataccacaaccaaatttaaatacattagagtacttttcactttcttcggttttgacatgcaactttgatcatttcttttagtattcaaaatataacgataaaatctaataatattgtaatattataaaaatacttgcaaagaaaaatttacccatattatttttacgttaaaactaaatattttgacaactatgaatagtcaaagtttcaaaaaagttttggccgaataaaattggcattgtaatatatttaaacgcggaggtatagtgattgttttaagaagaagaaaatgtattacagatgtagagaattcttctgcatcggacaaatgcattcactttttaattgcgtgaaaacataaggttctacgttatttcaatgtcaacactcacttttaagttgaaaatgggtactacaagagtccatacgagtacttatcaattagaaagtgagacatcgagagaaatgtattttaattaattaacggttcatgttagtcaaactatctgccaaatctctacagttaggcatggctgactttcaggatagccaatgccaattagccaaaatacagctcatgtaggctgaattttagtgttatatattcaaatgcaaaattatctggagatgctcacagtacgattaaattattaaggcagattaatctacataataactattataatctgggccacatgatccttactgattaagttgtcaggactctggttgtgatccaaccactatatacaacttttcttgtgctgtcagacatgtaactactgtttgttgaaatgttgaatgcctcatgcatggccatgatataatattgtttacctcagatatgcatggcactttgtgttgtccacattagaaagaattgtctcaagctctcaaaaaatacattttcctctcctcactaatggcaatagaagtccaagatatgcacatcaatgccagtcaactttttcattaataacagatgaactctattggacagtagcagaatgtctagcagctataagcctaggaataggatatataagattaattaactgattttcttacttcaaagatcacattccaagcatggcagagaaggtaagacaggaagatcagcttatggatgaatattgaaatatgggcatggtaagagctgccttgtattctaagcatggggaaaaaaagactatggtcaatggagttatcattaggaaggcagtccatttctacaagacaccaataatgtcatcagtctacacctcagaaaaaaaaaactattccaaggttaggaaaacagtctgtttccagaagaatagttctacctagaacacatgtggaaaaacgtttgaaatggttagcataggacaaaggcacagttggaggaaaacaatcagcatgaaaggtccttaattatttaaacaaattgatcatcattcctaaggcatctcactatctttccttggggtgaattgagaatcatatgctagctttttcctaagtgccctccttttgtgcgagaagaatcatctcctcagcttaatcatcaatcctgatgcattcacacattgtatatagttgcatggtttgtgtggcaaagaaattaaatgcagatgccccaaatccaaattaaatcagcatatatgctttcggtgcgttctacacagctttgcgaaacaactacttccatgttattcataagcacacttcccaaattgctaagcgatatgttttgtgaaaaaaaattatatagatgtttctttaaaaataaaaaaacatttttaaagtttgtagtaattaatatttgattaatattgtgctaatggcttacgttgttttggcatcgaaaatttcagcaaacaaactcagcctttgtaagactctataagctatgcttattcctctacaagatggggttgttggtggccaaggcattgcatggtggtgcatccatccacgcatcaactcccaacacaagcaaagccatggtagctctagctagtatgcttgtaagccagaacaagcaaaagggcctttgcaccaaacagccttgctcctcatgcaactccaatggctctagtttgcagggcttcttgcagttacacaatctttttttcagtccatccacatcagagtaggtcagccaagaagagggtgtcaatttagccatctcctgatcaatcacctaattactactgctaattctgatgctaatgcctctgaataatttggttaattaattcagtctgtcacgcgatgtgtatacgtcaacaatttacagctagcgcaatcaccggtggaaaattcgatcttccgttggtcttgtgcttaacagttaacactgacagatgccggaattaattaagctaatcagatgcagtcatcaactataaagaagagctgtagtagactgtagacagtgtatactacagtgtatctgactgcatggctgaccaaaacatgcaggttgattatgcatgcagtcactcatgcgtgcgcgcgtcagccatatctattattaatttttcagcgagcaacaacataaattaaaatttaaaacattcctaacctttctttcaataaaaaaaactaaaggattcccgggtttcatacgcaacagaatttcaatattaatatagagatttaaaatataacttcttttaagcattaaatttagttaaattcgttccaaggttctgatccgccaccgcgtatttatgtatgtataaatgtaagtatacatgtattatgtacgtaccttggaagcgaggacttggagtccggcgtacttgatgtcccagctgaactcggagacggcccagccggtgccgccgaagtcgtcggcgttgtcgacggcgtagtcgaggtattcgcggcggccggtggcacggtgcagccacagcgccgcccacagcagctcatccttgtacccacttgatgatgggtagtagttctttaccacctccacactctcgtcgtatctccccctgtacttgtccccaaactcaaacaactgcacccacaaatacatacaattatacttttacgtataattatgtacctgctcttcaaaatatatactttctacagttcaaaatataagtatttggggatagggtgatgtacatataaattgtacttgtacgcataattacaaatatacatactcttcaaatactccctacattcttaaaatatacaagtacttttatgcgttcctcaaaatgataccttttaaaaaacgtgcagaaatatttatagtttagtactgaggtggtaattttttttaaaaaaagaaagtcaggaaaacagttgctctatcgttgtcatgacatttttttgatgcgaaataattaggtgattaagcaaaggaaaaggtagcttaaagcgaaattaaaattttttgattttcttttttggagtagtgagtggtgagtagtgagagggaggacgtgcctgctgagcgtggtggaggaggagatgggcgtagtgggcgtcgccggcgcggcggaagacgatggatgcggcggccatggcggcggcggtctctgcggcgacctccgacccggggttctcggcgtccaccttgtacgcgtgccgcgacgtcgtcatgtcctccggccgctgccagcagtagtggtccgagtcgccgtcgccgacctgccattaatccattattatatctatacacgtatatatatcagggtttgaaattctggaacgatttcggaaatttcgcttatttcgtccgacccctctgatacaataattttggtaatatttgtttaaattcaactaaattttgtttaaaattttggaaatttcggcatttcggtgaggtccgatcaaatcgactaaaccgaaagatttaacactgatatatatacggtgtattgtgcgcgtatgtgtacagtatacgtattcgtgtacgtacgtacctgagtccagaggacgttggggtgggtgtgcgccttgatgaagtaatcggtgccccatttgatggcgtggagggcgtggccgagctcgccggcggcggcgatctcctcgccgtactccagcacgctccacgacagcatcgtgacggtgaacgccatgggcagcccgaacttgacgtggtcgccggcgtcgtagtacccgcccaccaggtccacctgcatgcgcacacagccacacacggcggtcagccacgacgcgccggacgaacacctttgcctcgccggcgacggagacgaagacgtaccccttgctcgaggccgtcggtgaggccggagtggccgcgccaccgcacgcgctggttgtacggcaggcggcccgaccgctgcgcctcgaagtagagcaggctcttcgacagcgcctcgccgtagtcgtgcgccgccgccgccgccgccatggccagcgacacggcgaccacggccgcggccaccacgaagcggccggagacgtcgctcatcctacgccgccgcccaaccacagcacatcgatcaaacagctcacacccctcacaaatatacaagaatccagaaatatcaccaccggatgatcaagctcaatcgatccagccaagatcgatcactaataactctcttcccaaaatcgaatcaatcaatgagcctgcatatgcatgcaggtgccagctgaccaccgcctgatctcccggaatggaaactgataactgaagattaatggcgccactaaacaacaatggctactgatttaatcacttccagctaaggcaaatgaacaagaacctccagctgccaatgaacaagaacaagaacactactgatcactgatgaacacacacagacacatatgctagttagctgcattcatgtatatatatgtatatatatgcatgtgtgtttgggtatatgtgagagggaggagagattaatggagaagaattgggcttcaaatcaagagaggaggggaggaagcaatcaaaatggggtaggaatataaggtgtgggtgccactgccatccatgtgtgtggaaagggaaggtgagttggtgaggttgagaaggtaggctttggtttggcttggcttggcatggcagtgtcttgagaagaggaggacagggacatgaatctactgggtctgcttggtactcccatatggtacaaactacaaagacaggcacaccacagtggagttgcattctgcattctctgcagtttggttgcaacaaggccacaaggctgatttggtggtgttgcaacaaagctatcctcatgttcctttcctaagctgagttttgttctggttggactggcccccacttcctatagctagcttgctccggtggtcagttttttggtaggtccagccctgctggtccacgggactccccgggcttggagcgtcgtccgatcgccgatcaatggtggagctttaaaagagaagaaattgggtttatatgtatgttcaatctagaaatgaattgtgtggattttggggcaggaacttcttgcagatttgtcccctgcaattcaaattatgctttaattttttctttcatttttttgtctcatgaaaaatccaaaatgttgaagccctacttgtgattgtgtgagaaataatttctgttgggttattccctctagaagagaattaaggtgcagggaaggaacttcaaggaagcaagtagggttctattagagcgcatgtcatggcaatatagttctctcaaggaaaaggtcagctaacgaatttctaggtgaaaactctcctagacccaattgcgaacaaaaaaaaaggagacctagctagcaaagaaaatatcaccacctacaaaattaaccaagggacagaaaattaaatccatgaaaagggataggttgaaatttgattcgcccattatataaaatacaattttttttacttgcatatatatatgtggctagctgttaatccaggttgagcaatcaattcgttggcatgttgctgtcaggaggtgttagcaagtaaacaccacacaagttgcaattgtttttgtgtgtgctgtgactgactgaccaaagtgtagcaggagaggaacaggagaggaggatgcgtcggttggaatccaaaaggaatgggaattcttaacataattatgctttgacgcatgagttggtagctagaggagatgaagcaggaaagaggcagtctctggacttggagttgcagaaagattaggtccacgtttacaacaagctcaatttagttcattaattactgtaactaactgttggtcaaaattgggccctgtttatgagggcacccgcaatggttatctatagtctcttataagagatccatgtcagcatattttcctacttggaagagattaaataaagagagagagcaaagctatttactaacctagagataatctatagagaaaaacgagacaatacatgagagagctatagatacccatgtagacatactattgaggtggtttactattaatctagtctattgttgagatgtacatgttttatagagagcaccttactttaccattgcggatgctctgagtaattaaattagacccactactaatcctagtgctactgtttgtgtcagcagctagctagcagcaccctgaagatactagttaagcttaagaaaaaggcttccttttttgcagtttagttctgaatgtagtaattgttattatttaataatgatcttgtcatatgtataagagtaaaaaaaatgctaatgtgtttagtatttgtgcctaatacgcagaaggagaaaaattacataccaatctccaattttaagcatatttctcccaattcccagatactacttaatctgtaccacctacccctctgtccaaaaaaaaaaatcaatcatacctacgaatctagatacacatgtgttcagattcgtagctaggaatttttttttttgggggcggagttgtatctcctaaaatagttgatttgtagcaattccaagacaaattagtacagagggaaaaggaccactgtgtcactggttgatataaaagtactattatcaggagggtaggttagtgatattgaagggataagattcatttaataataccttgatttatagacgaaaatagataaggaatcccaaatcaatattttgacaaattttgaatgcttagaaattaaattctctgtgttttaagcacagagagagtaggaataaatactgtctgataagagttgtttcatgtccttacgctacaacggattaagactctagagaaatattccattacaaataagccagctagctggtagttaatcaggtagatatcatgaacatattttcagactttaacatatgaattaatatcgctgccgtgtcaaatcaaaacctaagcaaacacagcttcaccaacacagcctaccgttagggagagattaaaacattccaagattccatcagacatacgtctacataatcaaacaaactgtcggtgcccagctatatattgcgtcacctgttcgtcatgacaggcagagcaacccttagttaattccatctatattcagagattcacttgatttcgcaggaaacagttcaattccggtagtaattaacatgagaggcaggatttttcatccatttttttttaaaaaataataacatgagaaatatgatatgaaaatgacaaagattcagtacgtagcaactaaacacatcagtaattacatgaaaacgtgtcaattgtcggcattaactagattacaatcagttgaagcaatgtactacaagttcaacgccgaaccttgacgacggatgggagcctgtgaacggatcaaagaatcatcactaccaggtcaaggtcccaaatatcatcttcaattcctctcccttttgtcagtctaaaagcaaaaatgattgattgaattccaagctagataggaaggtaagtagattgttagaaaaatagggatatatatctaggtacatgcatcatatgtttagttatttatacatggggccaaattaaaatgcaagtagtgagactgagaggtgatgtgctactacatgaaaattaaagcattaacttttttcatgtggattagtggatacattcatattcaaagcaagagcttgattgggttgttgcatagagatgagaacacaaattaggttgaacaattcatgacctttttcacaattgttaatttggttaattaagtatgagtaaaagattggcagtagctgcatcaggttaaatagtttatttgcatgtatatatctgcatgcactcgtagtttgactttgcttgtgatgaggaagagagaaaggtagaaaaaaaaaagaagttggtcgtctttgctgcctgaaaaggcctaacctttacctccccttctctttctgaactactaccggtcaccatccgaagaactaacaatgcactgtaagcctgtaataagcgtgcatgcattcgttgtgagacgtgtgaagtaattagagtatgattcgttctgaaaatttgaattctaaacatacttttaattattttgagttaatttttcaacatttaaagttttatccaccaattatatagttacgcttataatcagttctaggtgaaatgatggagatagactgtttcacgaatgccactgcaaatttacttgtagtaaatgacttcatttggcttcacgcttttcgtttcctgcgttgattgatttcttcagccaactgaacccagttcgacaccagatgaatatgaggctcagttcgtttgtgatgattcccaacctctccttctcgatttccgcgcgcacgtttttcaaactactattttgatgcgttttttgtaaaaagtttttatacgaaagttgtttaaaaaatcatattgtttcatttttgaaaaaaaaattagctaatacttaattaatcacgcgctaatggatcgttccgtttttcgtgccagagccaaacgttcccaacctgctctttcgaacagagccggcttgttgtcagcaacgtattaacaagtaacaactatagttgctacttcctccgtttcacagtgtaggactttctacaattgtccatatttatttagatgctaatgaatctagacatatatatgtgtttagattcattaacatctatatgtatatagataatgttagaaagtcatacattgtgaaacggagggagactgctactagctaggtactccctccgtcccaaaaaaaaaacaaacactaggtttccgtgtataacgtttgactgtccgtcttatataattttttttataattagtatttttattgttgttagataataaaacatgattaatactttatatgtgacttgtctttttaatttttttcataatttttaaataagacggacggttaaacgttggatacgaaaaaccatagtttattttttttttggacgaagggagtaagcaccaggatttgagggtcagatgtcagtatgtgttactgcgatctgctatgatttcacactgtggcagattgtatgctactcttttggtttggattagggtttttttttttgaaaacttgatttggattagctagtatgattctcgattagtctgaggccctatttaatttggattattgagagagaatcatcctcgtggattatctacctaagataaattaaactacatacaatttgaccaaattattgtaaaactatagatttaagacgttgtatcataaaatttaaatttaggccgagtttagttccaaactttttctctaaactttcaactttttcatcacatcaaaactttcctacacacacaaacttccaacttttccgtcacatcgttccaatttcaaccaaagttctaattttagcgtgaactaaatacacccttagtgactaatttattatgaacctataaatttaaggtcaagtatcacaaaactaaaaattctatagttaaatccctagtattacgttatgttggagctataaatgttatagttttatgattaaattatcactaaatttgtagttttctgatatttttttttgatactccatcttttatatatatatatatatatatatatatatatatgtgtgtgtgtgtgtgtgtgtgtgtgtagttttgtgagaaatttcacgttaaatataactaatatatagttatatgatataacaccttaaatctatagttttgtgaaatttactctaaactaaatagtagatagacttaacaaatacttaaaacaagtgatataaacaatgcaatagaaggatttttttagaaaacgtatatattagaaagtttctaaaaggaaatatctgataaaaaaattgctacagttgtagatttgtgatattgatttactttaatactccggatgatcaagcacaagtcggaatgttacagcatcgctcacaacgtcctctgccatagatacctacctatgttgaggcagataattaattaacaaacaattatttcgttggtgaagatgagttatctggagtatttaataagtgaaattgtgctattccttggaatactctctgtcttttcaaacaggaaattggatcctatacctcccttgggaagatgtatagatgctccctctttagttcattggcaaaaaagaagtgattatcgttttgttcatttggcccttctctagactataatgaatactcacgagtatcattcattgcattgccattgttgggaactcttgtctgaagttttggtatctgagatatgtatgtatgtagagattcttatggtattttgacatctctgattatgtatgtcttggcaggtgtggtttggaggactccatcctttggaagttctcaagcaatggacagttttctgtagcctcggtttatgagttttctccaccccgtaacgccaaaaatattttcggtaattggcttagaggggtatctaggtccattaagaagatgattctaattggagctagcgctgtatgttggtcaatttggcgttgtcgcaatgataaagtttttaatggtaaacaattatctaaccctatgcaggttatcttcatgtcttcctactggctccacttctggtctacaatgctaccacaggaggagcatgatactatgcgcaatggtgctacactcttggaatcggtagccaagggtctcttattccactatgggtggcgtagttccataagaattgctagctaaaatattttatgtggtttaacgctagtcaataataaaggggggttggggatttgtcccatcaccttatttctcattctgatttacttttatcttacctttttattactattaaacttattgctgtgtgtcttatgacagaagccggagatgtaatccatttccattatctaaaaaaaatgagtttgatggttaagggtcgctgcctcacggccgacaaccttgctaagcgcggctggccgcatgaccttggttgccctctgtgctcatatgagcaagaagactgtgatcatctcttcccaaagtgctcttttaccaatagggtttggtccttgctgagggattggctcaatgtgaattttatctccccccccccaaaggacgacaaggccttccccgccggagtggtggcaactggcgagacgctgttttcagacatgctacatgagtgcttttgacaccttatttatgttggtgagttggctaatttggatggaacgcaatgccagagtttttgaccaaaggagcaagatggccgagcaccttgtggcagatatcaaagaggaagttgcagtttggagagctgcggggtgcgtttcagtgttgtgatgagtagccctagcaatcccggtcttttctctctatctctctctctctcttttacttccatcccgatttctactctccgggggtgttggcccccggctcaatagtttaatgtcgtgtaaaaatctgtaactttccccctttcaatcttaatgaaatttggtcggcccctttgccgactcggcaaaaagatgtggtgcggcaatttcctagttcatctgcatttttttaatcatggatggagttctctgcacatacatacatataggcctcatcattattgttgggtttagtcccacatcagtaattgatgatgggggagcacgacttaaaaaggtgggggcgatcctcacccatcatactagtcttttgagttgtgtaggcccaggatctaaaattgtggctctggttgggcttgtggtggagcaggcccaatgtgacctggggtggcccacggtagatggcccgggctgcgcactttaacaattattagtccacacaaaagatctataattatggcagaaacaacttaacaactttatcaggcctcagaagcagagttccacacaaaaaacaacttaacaactttatcagtcctcattcggttttttctcttttaagtgggcagagtttatattaatagtgttcacatatgtagagttaaaattatcttcactcgttgcaacacgcatgtattttgtgctagtagttctttttttttaaaaaaaaaagtatgtctatattagggatttctgatactcaaatttactttacattttttcttttggcagaggataaaaaggtcggcccaacaagcatggacctttcttagtaggctaaaaatcgcctatgcgctaggcccatctccatataagggctaggttttgggccatgatcttcttttttctttaattattttccgcgaaacaacaataaataaacagaacaagggagggggaaaaaaaaagagaagggaaggaaaccctcgccaccacgcgtctccgcctccggcggcggcggcgccgcccgccgctgtaccaagatcccgcagccactgcgccgccggccgccgcgctcgtcgcccacgcactagtccctcccggagtcgtaggctgcgggttacgccccccgccccgccgcccggccgctctctccgggtggggtggtgggtggcaaggggctgcgccgccatcccatcaccaaccaagcaagccggccggggaacggggagcaaccatgtcgctcctacgacgggtggggaggaggttcctcgccggcgacatcctgtcgtcggaggcttcgccgcatgccgtcggccgcctcttcaccggtatcgtatctcatcttgccgccccatctgaggcttctccactaccaccactgcaggcattaattggcatcttgtcggcctcatcagagcctccgctaccgtcaccgctggagggtgtcaggagcccctcaccgctgccactgcctcgggctaccaagcaaccattcattggcatcttctcgccattcaagagttacccattgcaggtcataagggagtcactgccgctggtgggtcactcctcttcactcaacatgatcttcgctctcaacatgatatatcgtatgaacatcgcacttgtaacgtactatttgttttttgtcgcaggcccatcatcagtcacttagccgcaacgccatcggacctagctacaggtggccatggacgcggcttacatctgcagtagcactgccgaaactccttggcactaggtgggcatcaacaaatacctcctcaactactgggtaagtaacattgagctcacactctgcacaattgacataccgacacgttgtttaattcacaaatgagaagcacacaaacacaaaaatttcccccagcgctgcacaccggcactaatgggaccttttattccccacacttgctaaacaactaatccttgcatgcaaagctcacggccactagcacatatctgcatgcaagtctcgaataacacatgtgcaagctagttgatccactcttcatgtcacgactcacttcacttgacttggccgctcctccaagcaaatactcacccgctgctgcatgtagtcacttacatacaactcatggctttcaccgatcacactaactcgcacatgttctcgctgatttgctccctcacacacatgcacacgacttactataactcaaactaaaagatcgcttaaacaacaagattagcaatgcacctaacatgtagaattgccagttagcagcaggagattagatagaaaacatgtaaaaacacattttgaaatgaattaaattatagctgtgctcaatacaaaatgtagaaactgaaagactgaggtgtcaattacaagttgccagcttccacatggaagaacccggatgttgaaatcactacaacgctaatgctgatgcaaagaatcttccctgttaaaactatgatgaatataaagagctatatccctgataaatggacagggccggctctacaattttgagggccctagggcaaacttgacaacatgacccttaacgctctctctcctatagagtgacgtgttatatgtatattcatattttttggttgttcagattaatgccattttaaaccatatcaatttttgataaagttgttaaagatgtgtatccatttagtttttttaccaaactttagtaaatacataagaaatcctgctaaaactagacaatattactaaattgtaaagattttggtattgccaaaatttggtaagatttattttggctacaatatgaacagccccttcattttcaaagtgtgttttcaaatctaatcatagagagaaatgaacattgataacatttcatatatatgtttttttagaaatagaaaaatatcaacacttaaactgatcttgtttatttttcccatttacttagcaccataaaaatgcttcttgagtaaaattacaacttatcagcacctaaaattataaaggaaatatatattaccaacaagaatctatctttacatacaattttgattgttgaatctagaatctttattactccctccgtttcacaatataagtcattctagcattttccacattcatattgatgttaatgaatctagacatatatgtgtgcctagattcattaacatctatatgaatgtgggtaatgctagaatgacttacattgtgaaacggaggaagtaattcactaatcagtattatgtagatactagtagataaccaggagtggtagatagtatgtaattattcactaatcttaaagtactactttggctcatacagtactcatacaattttaagcatggggacgggccctaggccgtcaccctctttgccctgccccagagccgggcctgtaaatggaaatgcaatagtgtcacctagattcactatacagtctatagatgaactctaagaaggtgaatatatttatggttatgaccgaaaagaacaagcttgatagttggacgcaaaattttacactcgaagagaggaaaaaagagaaattaaaccctaattcagtttctggccgctagcaaaccggatgccacacggctggatgtcagcattcttacactgatcaccatgaagctgaatgacctacaaccatttaattatgttatcaacatatccgtgaagcagaaattgagaactagataagcattgccaagtgcatcatacctggccaagctctggatcttggagtacagtaccattgcagcagaattcctttttcagatcattgaggatcttgttgtaactgaactcctagccctgaactcatcatagattttgttgagatgtgctttgccaagactactgttttacaataatatttagtatttttttaatctttgtttcatattgtggttttcttataggtttggtccatgttttactagtgcgggagagttgattgatgcccttacctatgcaagagccaaccctcttatgagaaaggttaagatcatgggtagagaagataaaatcatatggattccaaatgacaatctcaggagactcgtgagatcattaaacaagacctatgccttacttcatgcaaagaagaagtgtctgtcctcattaacttcttcaaatgtcttagtgggtgaggatggaagtgcagtaattcagggtgttatagagattccttacagtgaggaagaagcttgttgtcgatacaatgaaactgcttccattctgaaagagctgattacagagtctgtggggtctgaagctattggtgtggattgtattgccgattttcgccgtctactccgccagatggagagcatgacatcggtttgtcaggagtacatcatcagcaaccacgcttcgcttatacctgatgctaacaggtattctactgcataatttgtatttattttgtgtgatttaattgtttttttttattactgatgtggttggtataatgtttaatataggacggcggtatttctattattttacaatcacatcatgggtaagctcgcccaggagcaaccaagactgaagaatcagattattagcaagttgccgtatgatgggatttggctaggcatagttatttccaaccgctttctcagaagatggttgaatagccatagggaatacgtgagtaccggggatgatgacatgagctttaactggaatgtccgctctcatttttacgtacatctgtggatctttgcttatagtcaattggaggtagaggaatgcttatatggtgagtttccagagcttctgttggagattgagatcctgctatggaaagcgaatgagatcgatgggctaggattcgaggataagttttagtggctttgagatatggcaatgcattgtaatatgggtgaattgtctgtatgacgtttaatctgagatcatggatctcttgttagggctttaggtggtgtttggatccagggacttaactttagtctctgtatttagacactaatttagtctattaaatatagactacttacaaaactaattacataaatgaaagctaatttgcgagataaattttttaagcctaattaatctatatttagagaatgtttactgtagcatcacataggctaatcatggattaattaggctcaatagattcgtctggattaattaggcttaatagattcgtcttgtgaattagtccaagattatggatgtgttatattaatagtctacgtttaatatttgtaattaatatccaaacatccgatgtgataaggacttaaaagttttagtcccatctaaatagggtcttagttactcttatctcttgttaggtctcttgctggcaataattttgtattaattattttctcatattgttatggatattactatttggaaaacatggtcacattgtcatgcacatgaagagggtcattgcttagatcttttatgtggctttcgtatcggggaaaattaaggggcgcagatggagatggtgtgggccgtcgacggtggagaatacaagtcaagactcaagaacgacccgtgatccgttctccatgggttgctctcctgtgaagctcgtgagattctaagacggaggaggacgaacaagttttactcatagcggcggcggtgataagctggagaaaaggaggaggaggagatggaggggtgtcgaggagatgggccgtgctgctctgcctcgggagcgggagcttctgcctcggcttgctcttcaccgacaggtaaccaatcaatctcctgctcttcagttcttgctttctccaactcgaggcttggagctcagctttggaggtgtgctggttgatttgtgctgcggctagctcaagatctgtggcatttgacgggcctcatgcatttgggggtctggattactgtgtgctcatggattcgtgttatgattttgggggtaaaatactgaaatcagtgccgctgttcttgctttcatgagggcatttggtgatttggttgcttcgattacatcgaattggagtgtctatgctctctaaacctcgaatttattattgggtaccgcattagattattggcttcgcaagctgggccttgtgcaaatgatcctgtgtgaaatatgcacataatttgcttccctagaggagtttctgctaactggtgtatcttcagttcctcatccaacattttagctttaccattcaactctccagtcactttcttcttcagaaatataaaaatgtcaaagaacagaaagcactttcttcttcagaaatataaaaatgtcaaagaacagaaagcatgtaaaacaacgatgctcaggaactgttaaatgattatttgctaatatggaacaaaaattatcatataattataccattatatctactgtcacgaagagtacattctttaacgccagtttagcagcaaagacttcgccccgagtgcgtcttaactcagtagaacaactgattatttttactatatcccattagtttaactgatttttgtctgtcgagtgcgttataactcagttataactcgagcctttcctatataatatcagtttataggcaatatggcctgagttgcagcatgctactctcatctccatattagcaataacacacttcgggtgcgtctttaactcggtagtacacatgatgaaataaatatgctataacaactgagcttaacaacacacttcaacttaattaagctcagttttatatagtaaagaacagaagcatatatgacgtgcctcaagtgcgtccacttcaacttgtatggctctctcatcgaatgcgtgtgtgtgatacagtgaagtaatttttttttaatttcttctgctgcgcaatctctgcaggtgttcgggttgcacgcatgaggtggatctggacaagccgccggtgctgcaggaggtggagaatttctttatgggtcactgagttggagatttcaccttcagcaaaggcagactggtacatgtagcttctaatttgtgccgtttggtttgtgtagttacattgtgccgaaattagtttaaagggtgatgaattcatgatatctcagcttcagtttggtaattagcttagccgttttggagtaatgttgtcgtgcatggttttgttcagtttgggagtaggtttggctaacacaaactgctgctggtgttttgaggacatcaagcaatgtgtccaccaggaaattttatcatccaaatgtagccagctagctgaatttctcattcaattgtgcagagatagatcgggatgtccatgttctcaaatatgatgggcggttgtctggaccatgactcaatcatcacgaccaacatttttgtggcgctgcaatgcatctgcattgcgattgggcatctactggaaaagaactggtaggtcaatgaatccattacagtgcttgtgttgcagggatagttctctcgcgctgcactccaggtgtttgtagttttgccttaaggaagagtagtttcagttctgctccatggcttgcaggggttgatcactagaggtgtgattcatgcttgtcagtgctggtaagaaaattcacacattcctgtcatcctgtgtttagtgaggacttcttcatctattacttccactgatcagtcttcaattttgggcaagctttctatgtactgattgttcgtgtagttagcttccaaccaaagtgaaatttgttctgtacgtgacaatgtgacatgtcttagtttaatttggttttggctaatttaatcttgacaacaaaatgcactgtagtaggaatcacttgagaaattcattatttcataagtacacatgatgaaattattttttacagttctgtataagatgttttttatatctctgaatttatcaaagccacatttttagaactttctcaaacccatgtaatttctgaatgtgaaggtgcacttattgaaatggatggattagtcaactaccctcccgttcctataaaactatactgaaaaatagattaaacaatcatgactgccctgtcccaaacaaatgtttttttccctaaaatacagacttaaaaggattgtatcacagtactatctggagctcttttacatttagaggacttaggtgctgagtgccaagtactggatgtgagtaagcttgatcatttagattatttagagaatcaacatccttactcctacaggaactgaattgcctaatgtaaatttctaggatgttcgtgtagttagctcccaaccaaagtggaatttggtttttgttcgtgtacttcaacaatgtgaatttttttcctgcagtaaccttggtttttgttcctgcagtaactgaatttccaggatgtgaattttcaggatgttcatgtagttagctcccaaccaaagtgaaatttgctttttgttctgtacttcaacaatgtcacatgtcttagtttaatttagttttggctaatttaatcttgaaaacaaaatgcactgtagtaggaatcacttgagaaattcatttatttcataaatacacatgatgaatttttttttaagttctgttattggttgccctgtcgatctattgagttcacaaggatctttgcttgggtgagtataaattttgaattctatcctcttcgtctgtttctcttctcttgctcgatttgctttgctgttggtgcctctttgtgactgtactgtacctgctacttttttttgttaatcttgtcatggatctcggaaaggttacctgatttcgcatagattttgtggcttaagaagtaacaatcattgttaaaataagtgagatttgaaataataattatttcctaataagtgagatattagataatatgctggtaaattatttcatatattattactcctaataagtgatattgttaattttttctcactcttcgcattagctacgtacaagcattataacaaacatctcacttactagaacaataatttaacattatctctcatcgttctgccatatttgcttacttagtccttcgctttctttaaatgattaataatgttttcttctgcatgccaggctgtggtccagtatatgaatgatttgaatgctgtaagaggaacaaaccagaagaaaacagatcggggaagcttctggaccttgctcttctcactgtttggttgttgcaaaaaggaccaagaactgggattgccagtataactcaagcatttcatctgtatgcatgttgtgaattactcaggtctgcaaagaaaggaaacgtgggtaatttggttcctcttctttttttggcttccttttttttgtgtatatatgtaattttgtcatgaacctgttcccgctgcttcccgaggcgttcaagggcaataagcaaatcggagtgatcggatggggctctcaggttcgaaaaaaataaacgctttctttcttgttttcagacttattttcccgtttcatttagatggctagtgtcgcacatgtgacatttccaatcactaattgatcaattgcgcagcaaattgcttcaataacgaacaaattgatgtgaccaatgtggtgaatgggttgtcaattgattttttacatggatttctcatgctactcgggttcaggacaagaaaaccacctgtattgtgcataacagagttgccattgctttttcaggggcctgcacaagcccagaatctgagggattcaatagctcaagtgaagtcagacattgttgttaaggtactcttatcttgtactgtattttcagttttgattcataggacatttttttgcagtactttggtatgcaagtcgccctgttaactgaaagctctgaaccatggtttgaagcctcgattgaactcctaatattcgttctcctttgtatatggctagcttgttaaggtgcacaggctataacttattatccattattattttgaaaaataactcgagttatacaatttgtcaatgtggacatcataattcataagccattatattttatgctcctcacttatgcaattttgcattgttctgttagtccagcattctattatgccctttcctttcagattggtctccggaaaggctccaagtcatttgatgaagcacgtgctgctggtttttctgaagagagtggaaccttgggagatatttgggagactgtttctggcagtgacctcgtgttgctgttgatatcagacgctgcataggttaacttcaggctctagctgcatgattttagttgccacttgatgttgttacctttaccaatgcttgtttgaattgtgctgaatttcatggttctgttgtttcatggtcttgtttattaaattgaatctccaatgccacatgccatctgccgtcacacagtcactccttttatcccttgtagatgcagcaaagcccacactcaaagagagatagttggtgatgaatcaggagctgagcttggcggtggagcgcgatgctttgctccaggaggactccatcgtttttgcgctcatcaagcagcggcctacactcccgccgccgaagctgccagtggccggtcccttgtggaaatggtaattctatcatttaccggtttcttcttctgttcaattgtagatagatccattggatttgatcctaatcaagttctatttttgaactgttgcagttctttcacatgaaaaaacttgtggttatcaaagctctggacatctacagaagaacaaggaatctggtatgtataatcatcatgtacctttattttgtttttattattacctagagttacatgcatttttttccttctgaacgaaggcattgggagaactggagaactaaatgatctctagaacataagacaaaaggcttatctgatttctacaatctatcagttttaaactcagtaggaacttcctattcccagttctaagagaggcaatcatctttaccttatcctgtaactgtttacttttcaccgctgacaatttagatgccacataaacacatacatttctatctattgttaacttgaaagactaggctgatccataatatttcttatattattaattagtaacctggagctgttgtcatagataatggaggagaatggcttattgttgtaaacatctttgtggctgtttgaaattatcatgtatcttttccttctttctcactaaccttatctcttctcctcctctcctccatacatgaaccagccactgcagtgaaaccaacgggcgaacgtgttgaccaccgaagtcgccatcatgtgatttccaccaagatcgccataagccggtcttcgcccaataacgttgctgtaaaaccccaggtaagttcctactgcttgccctaatatcttttgctttcgatcattgatccctgtccacactcttctgggcttgggatttgatctctatgtatgtgatgatttgaatgaggggattcgactaggaaagtaccgtgtgaaggatttatatgatattagtggcgtttgacctgattagattcaatctggcttttttttatcaaccctaggtttgatctgttaggctgaagattttgagaacaaattataatgggcggttagtttcaatggtactagaaatttcacctaggttttgtgtatggatgataactcaaacttccctaactgttgtaattcattcatgtattattctttaaggtgttactgtggtcaagtttttttttaaaaaaaactaatttgcgtttaggctagaattagcaaggcttttgtttgaagagttctaatgaagcataattttaattggaaaataagcaggatagaaactagattgaaactttttttttctgtttattatggttgtttaaatggcattctcatttttaccattctactgcctccaaaccccagttgcaagaacaaaattcaaatgataaaaatgaaatattgagattaagagcactatattctctctaaaaatagatgcaattcttctgagtccatgtgatgcaccttttggagtgattaggatttatcagttatacacctaattaaataatctctcaaaacgtgtatgattaatgcaacgagttcaataatttatcttgatgcctaatctaatcctttactcaattatcttgcaggcaatcttgatcaattaattttagagaaagagagagagagagagagagagagagagagagagagagagagagagaggaacgtctatgatcaattgctccagtttagagagttttttcactacaggaaggtgagatgaccaccaccagctgaaactgcactgtgtaggcccttgcttgagaagtaatggccatgacttgaacctttgttcgtctggaacagcaacacttcagtatgcaaaaacctcttggaagtggccatatacattttgtaaaatatccatcaattactattatccctttcatccatcagaattgtgttacttgccgtgtacggtttaacagagcactctaccaccaaattttgttgtaaacatggtatctaaaaactgcttgagcgatccagctatttagcactccgaaaatctaccactacgttatgtcagacaatttttttttcttatttacgttctaagcttctagcaacaacacggaataggaatcgactaaacaataaccccatcagctagtatgtcattaagcctttccttgtttgatctgctgataacatgagcaaatttgtggcatattgacccgctttaatatatcatcaatcaataactcccctaaccccatcgtttttctcatttttttaattatttttgggctatctcgttgttttacacgtggctgctaacttctcctactcgttgcgcgcgcgggggcaaccgtccataagaggtgcgccggttaattaaaactagaggatggggcgcgccactggcgcgccgcctgaagagagctgtggtgtaatacggtattgttattttggatagcagattgtaattaggaagagttcataagtagatgccacaaagaaagtagtatacgtacatagcagcagataacatcatcagcataggttaactcacttgagtctgaattaccagatgagcaatacatgtatttagtaagttacaaaccaacaaaaaccgccaataaaaaaagattacattcatttccaagcaaagcaaatctcaggaaacacttcaggcgaggcaccaaaactctccaggaactactccaatccaagcatgcaaccttgcctaacaaagaactttatgaatcccagattatttgtaataacagatctacaacagggtacaaccattccatcagagccaggagacaagatccaaagaacaattggcacagcgtgttaatcccgctaatgaagagcagcaacagcgcctggatcacccgacccttttccccctgatatcaagacaacaaaatataagccatgttcatcaattctgacatgcaaaggcatcacaaaatgatagtagtaacacactaaatgtcctcttgacatattcaaatgtacatgccaacaaacggaatgaaccaaagctaatatagcgaaatagtacttttcaggttatttttggggagtaatcaccgagtgcagataaagagtagggaaaaatgtaggaaatacactttttaatgcaacacatcaagaccattttgctcgtgatgcaaatcaaatcgaaaatcacatctgtttaatacataaacctactcctatggtaaaaaacttcctaaacatcagaatatcaataaatataaaaacatataatcaaatatgcaaccatctagcaacaggatttagcaatgggatgcacagttactcatgaagccatgaggatgcaacaatcttaatacacaggtaaatctaggctgcacacaacctcataaggacatgcttcattgcggggatggccagccagtataatggaaactctcagtgtaacaacggcgtacgatccttgcatcagagccagaagacaaggcccgaagaccagttggcacagtgtttattccgacaatgaacagcagcacctgaatcacccgagccttctacccctgatacgaagacaacgaaatgcaggccaagttaatcaattttgagatgcatagcaatcacaaaattatagcagcaacaaatttgatctcctctgacatcatcaaatgcacatgccaacaagcgaaatcaaccaagactcagataacggaatagagcactttttcaggcgatttttcggcacagtataaagaggaggacaaacagtacgcaatacacttttcatgcatcacatcagggcgatttcgacataatgcaaatgaaatccaaaatcacacctggctgatcacataaactacattctttccaggaaagcagaatgaaactcatgagcatgtaaaaatcctaatgcacaggtagagctagcttggacacgactctagagggattgaattgtgatccatgaacaagtagggataaaagatgaacatttgaggtcaacaagggcaaggagtcaaaggattagggaggattatgttagaattaccttatttaggtcatattactataaagttcttgagaaaaaaatgtttatcaatcatctataatgaggtggatagagctatgtcaactgcagaattatgttaaacaccacagcacaccaatttcaggataatagcgagacattataggaattgataaacataaattgatgttggtacacaattaataaggctaatgggatatctttattatatgaggctataataatcctcttaaatctttgtaatcctagcgtaaactgcgttgatgcttttggttcagctaataccggttaccagagtaacatattgagcctgcattacaatcattgttgcttggaaaatatattaagctaagattgagaatagcacaatagggtgcttcactggaatgatcaatttatattttgatttcacgaaatagtaaaaacaaaaatactcctacaacacatttaacctgtccaaccaaaatagtgcattcagaaaccatgttttgcagagcaatagagcatcataattcaccaaatatactaaacatttcaagattagcacaacaacaactaatttcaaggcttgaaggatgttctctgtaaaataaaaaaaaacacctttttctgcaaggaataaagtaaaccatatatgtgtgaggctatgacagacctgttcagcaacaaatagtttggataaatgaactgaatttatttggtggcatgaagttgacagttaatatttcgagtattgctgaatgaaaaatgcctttagttgatcactctgtctaattctgacatcaattaacccaaaccaaaatatcaaagttattgcaaataaggacaaataacatttagccctgcttttgttgatctaagtctctaacagcgtacaaatcacaagtggtaaatcgattaattcaatgtaaggagaaccattttaagttaagcttgaaaggaagagaaaattttacaggtgcataacatggagaacaacaggtcaatgatccaaccaaattcgagcaggttttatacattttgaagtcagcggaagtgcatagtccagaacatagataactcaccttttacttgagttgccaagagctcaacagtacagcctcatccttgcccttcagcttctttgctgttaccatcctacaacaatggtatatgtcatgagcatttgctgaacattccctcagcatttcaaaacaaggctgttgaaaaggaaagaaagttgaatacttaataacatcaagataaatctttaaagtattccctaaaatctaaacaaaaaaagtatttgtaccataactaatgtacatagtctccggagcatgacgctgataatgagttatatgaacaaactaatgttcaggaacaaagacaagggaaacaatatattaatgaagcgctgctacacatttgtgctatttcataaccatatatgtacatggcactgattgcatgagaaactacaaaactaagtatgacagatctttcttaatatccatagccatgataccaagtaaaactttttcataatacttttgtataaacacaagtaggtcatattaattaagcacagagaaaagttttgccagaattctatatagaaactattaagcaaggagtcaccaaatggaaatcaatcattacgagaggatgtataataagccaaccatggatcaataaaaaacaaatcagtggaataataagatgtgccggctcaaagaaaaaagcacttgtacctaaagagcttgccgcagcatttggatcaggagtcttcagcattttcatacatttgttgatcctatctctttacctgctaactgccacatccaatttattactaatctccccacattttcccttctatgtttctttgtcttgtgtctccaaaatcttgccagtttccttacatttgtgcctctcaaatgacacctcaaccccacatttgcctctcttttaactcccacatttgcctctctttaactctttgccatttgtcaagtccaagttcatgccaatatcttcaaatttgtctcacgagtcggtattgccaatcttaacattacctgtttgattatagtatctgtgcagctctccgaaaacaccccaaaagtaaaacttattacattttcctgttaaattggtaattatacaaaaaaggttagatgataaatttgtacatgcatactactttttaaaatatttaacagggactgtatagctatgcacatgcaaactccatgtgatttcatctggttgtaagagaaactattgcgacaaatcaaaaacaggtattacaaaaaaaattgaatttaaaaaatattcatacaaataagattaccaaatagcaactttgagaaatggatgcatcacagtatcagtttgtttaagcataccaagtccaagcattgtcagttatggggggatacatgacatggtttggaaatgggacataaaaaggatcatggaacatattttggtattcttgggtaagcaatttggatgaaaatatcagcacctagtagcaccagccttggttcgtaacccaatatgcaaagaaatatttttcaggagatggtcagaactcccgtttggtctgcaaagaaaaagagagaaaacacacaaatgcagataagcttcatgcacacagctgcatcctgtagttgataaaaagagtttaaactccaaaagaactcgcattcattttttcaggataaattgttgaattggttttcaattgccggtaactgaaatgaatactccccccgtcccaaaatatagtaatttctagcattcgtaatccatcccaaaatatagcaaatttaccacctacattctctcaaccaatcaaaaccttctctgtttaatttctccccctacctccttttctcaacaaatcataacattgacccatttaattccacctacttccttaatactcgtgtttaaccccaaaacttcttatattctgggacggaggtaggacttgttagtatatgacaaatgatatgactgaacccactaaaatcattggtgatacttctgaggattaatttctatcatgccaccaattaaacatctgaaaacgtccttattttataaataatgagatgggtccacaccagtaggtccacatgccattgagacaagtgagaggaacaaaaggaaagtcagtagaagcatcgatttgaagggtcatacctttgaagagaactaatgaagcacagtccaatatcttgtccttctggaggtttcatcttgaatgtttttggccacagatgagaaagagatctagcctgcagctttaatatttcggccattagttttgaaggttcatatacttgggcagaaatttcgaaagggaaatgggcttcaagtccatcacaaatatgtgttagctccagtcacttcaaatttacccctaaagaacagttgctactatataaatggaaaggattgtttgtactacccgtggagatcaagttatctaaaaaacatctttgtatgtatataagcattagtatgacactttgtcgttgtgcagttaattatatgacacctcaactataatatgcacagtcagcaaaggctttgatccacctatctagatatttgcttttaatctggaagtagtgtgtcaaagaaatagtggaacccttacgcaaaggtgtcatagcctttaaatcattaactatgttgattgtatagatgatcttacaagccataaacttgagattttaaacgtactatatagaactactaaatccatacagttgtagaaaatccaacaagcgatgaattattgtatggaaggacatgggttgaataaatgtaattaacttgagaatcccatgcaaaaaggaaccgaacacatttaatttgtctaaaacactaaattatatgaaggactgaattagacagattcatttatataaactcgcatttaaccggaataagggccataataaataaactcaacttgaaacaatgggagcgtaaaattaacaaatctgtagttcagtgacctaatgaccaggaatactcacctcttgatctgtgaaaagcccaatagtacagccttatacttccgctttggcttcttgcatttaccatcctactgcaatggtagaagggggaacactcacaacaatagtaaagcatatatactgcctttcatagtagtcaatgctacctctaataaatcaattttctggtgaatacattcagataacaagtgcatcccctaaagtaaaagaaggaatggaggacaagatatttaatcaaaacaaatcagcaacacaaaaaaaattttcacacttacataattattttataataatttaatagttaattaaaataaataagcaaaatcttatcagagctgatggggagaccaagattaactaaagaattcccagaggataatttagtatgttgtggcagtacatgcaccgatgatcttgcataatacaggtaagctagtgatgtcattttattaagtatgcgcttgtttgcagtgacctgatcgccacccaaaaaaaaaatcaaaaggtgttaagaatatttaatatatcactgcttaattttttgtcaaatatctgatcattgcttagtaacataacataggataatggcacgaatgttttactgatcatattcctcatgtagagctcccaaaatagatatttttgagttgtgtacagaccctcaagctaaagtacaatctgcagatataattgtgccgtaacgccgcttgttgcaactaaatggacacccacttgattggaagtagtcagtgcctatcaacaaagataatgcaggcattaggtgaatttacagatctgactgccaagggcaaaatgtgcagataaatgaacttaacacattagcagtatttaaaagaatattgatctacaattttcattactgatgaaggggaaaaggggggtgtatagaacaatatatttaagtggatctgaaactactacctttcacatagaggtaccaaagatgtgaccaagaagcagcttcattcagtaacagctgtgctttttgtacataagctatcctccaccggcgaaggtttcttgtcccagcagacctgaatattggatggcgttgaccagtcccagataccaaagattaggcatcagagctatgataaaaatattcatctccgaaactttcagaatttagacaccaagtatattttttagataatggaagcttcattgaactgatcattaaattacatcgagatgatacaactgtcctaagaacaattctgacctctgcataattgagatgcatacagccaagacaccaaatatttggacataatattttagcagtccaaaggataagattccttcacatatatataatcaaaaagtccatgatcgataagacataatgatgctatgtacgaattgattaccactgttgttagacttctgtccatgcaaaatgcaggatcatcctaagatattatctgaaaaagatgagctctgctgatatatgacgagctccaaaacttctaaatgaactcaacaaaacaaaattagtttagtttagtattttcagatttacccaaacaaatagttaagcaaaggcactatcctgtcatagtattcatattagcaaatagtttgaaaacagatgtaacaatgatgtaacagactcagcaatttgtaggacataatcatataaacatagattagtttggtaacaaagatagtaagtttcaaactttaggaagtgtgcaccacgacagttcagctacaaataaaagataaacagataaaaaatgttcatgtcgcctaagccaattgcatgattagattctgaactaaaatctcctcaaactgaaattccaagtcagcaactcataagattaatcaaatcaggtcgtatctggaccaagtagtaaccagatttcctcttggtcttgcctgcagttaagtcaggctagctaacaatattttcaggtccatttggcacagacgacattgcaccccatcagcatgtgtcaaatagcacaatattttacctccctggaagtatcaccaccaaaatccatctttgtggatcaggccatcgtcgatgatggagctgctgatcttctactccaactccaataccataaagttagtgacttgccctgaaaaagaaataaatctagaagatataaaacatatttagaataaaaggatgctaaaatttttaccagaaagagctgacttcctaggtacaaatgtagtagtacaattttattacttgcaagctgaatactccttaacctcacaatcagaataaataatcaatgccaatatattttgttcctctgaattatgatcagtatgtggataaatgtattacccggtaataatccgcacatatttactaacccacccgtcatgattagtgaaacatctagcaactgatttcacaatagattactaaaaaaggggatattcctgtacagtttcatcaagccactgaattatcttacttttgtcccaagataacatacatggcatcatctactaaccacttatagtacaagtgccggacaaaattgaatgtctaggtttcggtataaacaaataaaatggctaggtttaagaggtatagaaggataagcagtcaggaaatgaagacattacaccataatggagtgtttcttaagcattgtattactacctaatagtttgttctagagtgaaaaaactgttgttagtatcatctaaaacttttatctggaaatcatcaatcaagcagaaagcaaaggaaaaggcacaaaaatacttcatcacatgagcacgtattagctaagaactgcattgatttataaagtgagtacataatatatcccttaagacattagcttaatgacttgttacggtcttatttgtaataggagcagttctaggggcttctctgatgtacatttccactgttacaagaataaagatggcggatgagaaagtacataaaagatccatgtggaatcagaattatcggtggtcaaacgaaaaaattacagggtaaggtaaagataattgtctatcttagaaatggaaattggatgtttctggtgagttccaaatccttatagagatcatacaaatcagattagaccttttctctgatattctaaagatcagtagttctccgtatacacttctattcagggggcgggggcgaagcaaaaaggaaaatgcatgcaactctatagaagaaaaaagaaaatgaacccacacaatgattatgcatacctggttcttctgtacttaacatcaagcttttttcatgtcaaagaactacattagttcaaaaatatgatttgatcaagatcaaatatagtagatcaatcaatgattcagcaaaagagaaaactggtaaatgatatatttttaccatatccacgcaatttatgatgccatcattgactgcacaaatcttgaaactttccatcaatgcctgagtaagagtaatcccattatattgccattcatcatgaacaagagcaatcagataaatggttctaaccaacaccactcaaaattcagaacttacaactgaggtcagccataccagagataaagcacactgtataagttagcttttagatgctgcaccgtcaggctgcacacacagttataacattagtaaaaatgagccaaactaatttagataaagcagatgatataccacaaaaggttgtgcatactacctgacaagtgacgaccaagtgaccaactaaccagtagagcagttgactgtagcagttgctccaagagcccttccttgtataggttctgtcaaaagatcatcaagttatgagtgtttttaacagttcaacatgcaaacatttaagtatttaaccaccatagcatttccttcaaaatattacaaaatttttcccctgggatagtagatttcttgctcagaggtccctttattaaggctattattgttcatacaattttttgaacttcttagttctattgacatggacaaatacatacgatcagtgaaataaggtgtagcaactccgtgatgatacagaataatccaaatgctaatagcttaggaaaaatagcttatcctgcattaaatagaataatgaattataactcacctgaaagtggaggattgatggtttcactaatctagttttgcagcgaaattcataatacttgctgctcttatccacttgcttgaaaaactgcatcactgcatcagccatcaggggaaaaacaatttaaatcaaaggcaaaacatttagatccttgggaggtaaaattatcaaggtatttttaatcgaatattacagccaaactttaacagtgaaacataattggttgtttgcttagcagccgcatagagcacactcacacaatggatgatccttttcggctcttgtcacgcatcgatcatggacatatgctgtaggtcgagaccgccgcaactgtgatgaatcaccacacagacactgcctcctagttgaccctaaacagcaacagctgcagaaagaagacatgaaacatggaagaaacatgcagcaaaggtgcatctaagtttctctaaccattgaagcaaggattcacacctctagcaaccgtaaagccaccggaccaccgcactgatccggccgctgtagagctgctgcttcaccacggtcgctccacggcgatagcccgactcacctgcagccccctcacacgtcttcgcgctagggccttgggtatccagaagtagcctcaagggaaggcagggtacaagaactaagatcatcacaagatcaaattaatactgcatatcaaaatctacctttttctaattgactaatccagccagcaagcaccaatctcggatcacctaaccacgggctctgaatataatcgaactaattttcagtcaagacacaattagaataggaaatattgccgatccctaacaattttatccatgaaaagaacaacaatggcagcctgagagagagagagattaatctaaggagagatgggagagaaaggggaggaaggccatctctctgcttttgcctgccggagcatatgccatggtcaaccgccgctggccatgaccgtggaggcagcgaagacggtggagacggcgctgggtaaggaactaacggcggccgccgggcatgttgccgccaagctcgttggcagattagtgccattatcaagctctagcctggatccacgttgccgttgaggtcgccatctgcttcgagccggcatggagctcgtcagccagacctgcgcgaccaccaaaatccacgccgccgtcgatgatgggatgtggggcgggcaactagggatgatgggagcggcaggaagaggtccccaatagatcttgaaaggcacatgccacctgtctagcaccggagagggccaacctagaactgcatcaaacaacaatgcatcacaaagcaggacatggccgactgaaaacaaagcgtcacacagcaatgcatcacaaaggaagcctctctttttcaatctggcctctcgggagcgaattggtacctcctgaccaccgaagagattgagccggccgacctccccaccactggcgctaacccgctcccgctcctcggcattcttctccaggcagtggtcgacggtcagcagctacacctcaccaccctgcgtgtccaggatgcaccgcgagtccccgactgactccaccgtgaccgtgaatccattgatgaccaccagcgttgccgtggtccccgacacctcccccgagattgccatgagagagtgcgggggtcgtcgccatcaccaccgtctcgctctcccgccgccgcatccgcctcctcctccgccgccgccgtcaccatcgtcgtcctcttcgccgaccgccatcaccaccgtctccatctcccaccgccgcgtccgcctcctccgccgctgccgccgtcgccatcgtcatcctcttcgccgaccgccaccgcctcttcctcccttcgacccctccgaatccccgtcggaacgagcgggcggcggcggctagggtttggggggccggagatggtggcgggggcgggcgacggcgacgacgacgcgaggcgacggggaagtcggaggcggcagcggccgtggtggcgcgaggcgacggcgacaacgatggcggagacgatggtgggagaggggtggcgacggcgacgacgacgacgatggtggaggtggcggaggcgatggcggaggcggccgtgacgaggcgaggcgacggcgacggcgatggtggggatggcggcgcgaggggtggcggcggcggcggcggcggcgcgagccgctcggtggcggcgctggagagggagagggacagggtgcgggcggcaacggatagggtttgggggtgttaggtagtgaacgccattttgcgaaaaagccctacatattccacttttacatataggtccttatccgcggattctcctctccaacaactgttcgagaggggcatatatgttattacataaaactggagggcctttttgcaaaaatacacccgagcactgtagtactgtaccgaatcgctgacgtggcatagtcgagcgaccgcccagcccgccacacttaatattttacatataggtccttatccacggattctcctctccaaaaactgttcgcgaggggcatatatgttattacataaaactggagggcctttttgcaaaaatacacccgagcactgtagtactgtaccgaatcgctgacgtggcatagtcgagcggccgcccagcccgccacacttaatagtttctagtttctaatttgggcgctattgtggtgtgcatacttgccggttggggtggagggctgctcccggtgagagggctgggcatttttgtaaaaaactcctcgtgtttgcacggaatatcacatacatcttcggaccgttgtattttctctgtccctaaatatttgatatcgttgactttttaaaatatgtttgatcgttcgtcttattcaaattaatttaagtaattattaattcttttcatatcatttgatttattgttaaatatacttttttatacatatagttttacatatttcacaaaagtttttaataagacgaacaattaaatatgtttaagaaaaatcaacggcgtcaaatatcttaggacggagggagtacgtacaaccgttacaatgcagggaaatcaattttgagggaactgatacgtggaaaggtattgtagctagatttctgttgttgaccataaagttgacaagttagtattgggacatatcatctagaaatgcatttacaggttgctctatttgaatatattagaacaacctctacttacaccactattggagcagctggcccactaacatacgctgaaagagacgaacatgtaattaagttccaagtggcatacggtgttttcttacagtaggtatgtaatttgaggctcggagttcatgtcagcaaatatatctatcgtctaccatcatgagagagatgcctagatactacccaaaacaacattgcaaaatcttttgtgacgaagcagaaggtatacttggtagccacaagggctaaggatggccgtgcccgtccttgttcttgaggttggcgtgcatctgctcaaacttggcttgcatttggtcagtcttgctattgatgaaagtgttgtgactgaacgcggagcgttgcaggcatccgcgcaccaggttgagctcagcgatcgtacggcaaccggctgcgatctcgaagaatgcgtgcaggttggcgtgcactcccatctctagcagtttgagagcctttcttgccttgccagatcggcatagttgtatcagttcaaccgatccaactggagatatcaggtgctttgttttgtgcagatcatggtaattacttttgagctgcttgaaaagccagaacgcctcctcaaactcttccgcattgtagctgacctcgatcatgagaagccaagagtcaagggtacgataggccatttgatcaaaggtcctgcgactgaactcgagcagatcgcacttgggatacatctcaatgagcttgttgttcacgccgcaatcgttgtgaaagccggagcacaggaagtagtggtggacatctttcaattcctccttcagtgctggagtcgagcagcttgcggcgagctcttcgaaggccttgcaattcccgcgagctccctggcttagtagatggatcgcttcattgacgcgtcccgcttgagcgaggttgatcagatcggctggtccggccacacgtgttggcgccggttggagttggcgctgccgcttgatcgctgccggagtgggctgccctgtgcgctgcttcatgggtggggtcgtggcggacgccggcgcgggagatgggaccagtgcggccgatgacgagtaggcgcgggtggccgcggcggacgccggcacgggaggttgcttctgctgcggctcgagctcgaccagtgcggccgcggcggtcgacgacgcgggtggccgcggacgagaacgtgcggcggtggcggaccctggtgcggggggctcgtccttgcgcggctggagcagttcagccgtggcgtgggccggtgccgcgggcgcggaggtcgacgacgagaagccccgggtggcctcggacgaggaggcgcggaggaggaggaggtcgtggccgcgcgcggcggcggcggcgatcgacgggatgatgcggacggcggacgacgtgggcacgcggaggagagggagcgcccaccagcttgggagccccgccccagccatggttttggcttgaggtaggcgacgacgacgcaggcaggagtcgcgagccgagggatttgaaatgaacccaaatcttattttgtggggaaatcttatttcgggagacttctcgcttcgattacttcgcgtttagcaaaatcgttgggtatgtattttggaaccagtaggcagctgtacgcatccatggcatatgagtcgaagagcatggcatggcaagccgaggatccgaccggtcggccgacgtacgtggtgcgtcttgacgatgtcggtgcgggtgttgggaacgggacgccgttgctggcggcggattgtgagctcggcgcgcgcatgcatgcggtgcgacaccgctggctcgatcgctcaagatcaacgcactcctctccactgccaccgtcgacacgcggagaaggcggcggcctcgcgggctggtctgccttagttgggccgagcccctggcctgtcttggtgctgggccgagcgaaacaataaataaacagaacaaggcaggggaaataaaaaataaaaaaacagacaagggaaggaaaccctcgccaccacgcgccgccgccgccgccgccgccgccgccgcccgccgcgctaccacctgttgctcgtacgatcggattcaaattgtcgcttctttcttcttccacagcacaggtatgtttgttttgggagatctggttttcagaaagataatattggattggattgaatcgaatcgatgtggtttcctacctaggacggggtgtagaagaagaagaagaagagcatcaagaggatgggttcactgcggcgggttgtgcacctggtgaccgcattgaacggcagcgccaacctccgccacatcgacacgtcgcgtttcttctcccgccggccgccgccgccgttcagcccgtcgtccatggcggtggtgacggaggaatcctccttgccggagccctccatgtcgttctacccagctccggccccgccggagagcaacggcgacatcggggtgatgctcttcggccgcgcccgcgacaggctgctggtgacggaccagtccgacagcgccgccatctacgacgccggcacgcacgccctgctcgcggagaccaccccgctgaaacccaagtactggccagtctccgtccctgtaggcgacgacatctacctcttcgacctgtaccccagggtgccctgcggcggccgccattgcttcgaggctgtcacggcggtggattcctcttcttcttcttactgctcccgtgcgctcccgccgccgccattcctgtttgccccgggctacagccccaagcctatcgagtcctacacggtggtcggcggatcggaggtgtggatctccacggcgcgcgcgggcacctacgccttcgacacggttagctgcagctggagcaagcaggccgactggccgatgccgttcgccggcctagcggagtacgtccccgagcacaagctctggttcgggctctcctcctccaggagggacaagcacccgctctgcgccgtggacctcgccgccgccgcctcgccggagacggggccggagctgaccaacgtgtggatggagctgtcagtgccgagggaatggatcccggtcgaggccttccttgtgcaccttggctctagcaggttcttcgtggccagattcttccaagagctagtcgaggtgcgctgcgacttctcgcagcggttcgacaggttcgctgtcttcaccggcgttgagctggagcgcacctcccgtggtgagctccggatgatcaagcacaagtcggagcgttacagcatcgctcacaaagtcctctgccatagtgttctttgatttcacaacgtcctcatcgtacctatttcctccgtttcatattgtaagactttttagcattaccgacattaatatatatattaatgaatctagacatatatacatgtttagattcattaacatctatataaatgtgggaaatactagaaagtcttgtaatatgaaacggagggagtatatatatgtctagattcattagcatacgtatgaatgtcggcaatgctaaaaagtcttataatataaaacggagggagtatctatgataaggcatgtaaacaatcaattatttggttggtgaagatgagttagctggagtattttgaaattatgcaatttcttgtaatactctgtattttcaaacaggaaattggaaaatagatgctccctctttagttcattggcaaaaaagaagtgaatattgttttgttcatttggcctgtctctagactataatgaatactcaggagtatcattcattgcattgccatcgattgaattttcattacattgccaacattcgaatcacacaacttttaaagtttgcatgcagatgttttagcatggcattgtttcccgtctgttactattaatcttgggattgagttgagtctctgaatgtggcaattagtctagagttggtttttttaggttcctcaaaattgtgtatgtaatgggggtgttactttgctggtgatgaatacaatgacatattcacatccatataggcatcaggggcatttctttgctgagatatattaacatattcacatccatatatgttgggaataaatggcacccatgccaactgaaaacaccactttttaggttagatttgtcgcagtgcatcacgtttcgtcgtttctgtttgtcttgccattcaaagcatgcacctcaagttgtttcctagctgagtctatagaaggagctaggcagctagcctataaaagtgattagatttactttgattctttgaagaagacaatctcaatccattttattctcaagccgttgatcaactataattgttttttacatatagattgttctggttctcaaactatcctgaaaactttatgcatttttttctaatcttaattaaatcggtagcactcctgtctcccattgttccttttctttttttaatgtcactacctaactgaagcttaggagcaatagaacagaactttgaacttaggagcagtagaacagaaggcgctggatggatagaactgaaccgtgagcttaggagcaatagatcagaatgtgctgtatggttgggcctcctattgtaagtcaatttcttttaaaaaaaattgtttatgccttcatcgattactttaacatcctctatgccatcctggttaaaacagattgagattgtccggtgttccatgtgcgtgtgcactgggagtggctttgtcagaattcttgttcgacttgatctttggcttaagtgaatctaatgtcaagcaatttatgtgccaccctttctctaacatagtggtagtcaacttcaacatgctttggttctagtgtggaattattggataagctgatataggttgcatcaagattgtcacgccataagcatggtgttctgttcaggtatactccaatctcaactagcaaagactgacctggctactgtgtgctggtttcttgagctccatgagaccaagtttttgccaggaaaagctgcaaatcgtccagtagaacatgtgtcattgaggcatctggatcaagctgcatcagtaattgcgctgattaattttgtagtttccttcttgtctgataacccatgatatatgatgattcagatatcttattatcctctttactgcagaccaatgtatatgaactgcaacaattggcaacaacgaccctccagtacagtaacttgttcaggtgatggaagggaagcttcttagcccagttgggcaatttttctgaagttaacataggtatgacggcagacctttcatatttgttctctttatctttagcagatcagcaaggaaagtaatcatatgatttccaaaagaaattacagcatcagacctttgtcaagaatgcatcatatgcttcagtttcagcttatgtaaatgccatattctgtaaaccatatgatgatgagattacttaaattgtgtttatcaacaggttggttattgaacaacattcgtcatcctaacatggttcagcagcaactccacaccagacaagactccagttcttccatccgtgactcttcaagagacccaagcttcaaactgccatgtgaatcgatcggtctgtcaacaagcggaggcgtccatcaaccgtaggatatgattgttggctgcagccaaaaattacaaaaaaaaattgatatgtttgcactgaactggagattaagcagttaatctgttcttcagattacttcaagccggtgaagcaaagaggcaattatgaataccatcacatttcattaccaggattagtggtgtgaaaaaatagcatgagagccttgcatgaatgatgatccatcaaccatatgattgttgcagcaaaaatcacacaattttgtttgatgtgttcgcactgaactgtttgatgtgttcgcattgaactggagcaatctattattcagattactttaagctggtaaagcgaacaggacaagacttaatcatagattaccaatctttactagtactctgtttttaaatattttttaatatactccctcgatttcatttcaaatttatgatgccattaacttttagtataaagttttcaaaaatcatattacctccatattttaatgtatgccgccgttgactttttgtttaacgtttgaccatttgtcttattcaaaaaatttattcaaaaaatttatggaattatcatttattttcttgtgatttgattcatcatcaaatgttcattaagtatgacataaatattttcatatttgcacaaaaaatttgaataaaacgaatggtcaaacgttggtcgaaaagtcaacggcgtcatacattaaaatacggagggagtagtttttttaaatataatgtgtgtaattaaatttgcctcgaaaaataatatcatatttatttaatattaaatacataagggttcaaaaacttaatcaaatcatcaaattacgattttaacgtcaaatatttatgaccgtattttctaaaaggtcagtattctgtttcgtccaaattcaattattaataactggactatttttagtcaataatatgagaaggacaaaaagggaaaaaaaaaaaagaaaaactctcctctcgcaagcgaagcaaagcatttccctccaaatccgctgcttccctccattttggcgccacaatctctctctctctcctcctcctcctcgccggagatgtcgtaccccacgttccacgtccacccgccgttcccggtgtcggcgaggaagaaggaggatgacggcggcggcggcggcggcaagaaggaggcggcggccgccgcgatgaggcggctggcggagatggaccaccgcgcggcagccgacggcgggaaggtggtggcggccgtggccgtcgacggcgacaggggcagccagcacgcgctcaagtgggcggccgaccacgtcctctcgctctcccaccccttcttcctcctccacgtccgccgcaagcacgcctccctccactccgccggtacgatcctcctcccccctcagctcacccatctcaaccctagaaattgatcttgacgtgatcttgatctcctttgggatcccggcacggaaaacggagagatggattagcgcacgattaatgaagtattgggttattggctaataaacttgaaaaaatgattgacatgattgatatgatagataatttttgcaaaaatacgtatcgttcagtattcggaaatcgtgcgcgtagaaaactagtgagtagaggttggaaaaggggagaaaagaacccaccttaatctgtctcatttgatgtgcatccaagttgcggtgctgttcatgtgatgtgcattgatgaattgtgaattttgcattgtattgttagagtttataaattttccaagtttttcatttatgcagggggaaagcaattctccctattgcacgtgcaggatgatgttgcagcttcttctcctgatcaaatggatcatcacaccaaagatctgctgctcccattccagtgcttctgcagcagacgaggggtatgcatccatttttcctacctctaccttgtcacgcagagattatgttcattttggcggaatctaaaatctatggagatatagagagtttctgaaaactacagactggaatgctcatgttggcatggacctgaaatcgatcattcatgtggcttttcatataatctattaagattttgctttcctttgtttgacctgatgatagcatgagcaaaatcatgacccttttttggctgacttgctttaatatctacagttacaatgcagggaaaccattcttgatggaactgatgtgtggaaagttattatagattttgtccttgaccataaagttgacaaattagtactgggggcatcatctaggaatgcatttacaaggtgccgtattattttacaaccattaagtcaaagaaaattgcaaccatttctatttacagtttattttctgaattgttttaatacttctcttttgattgctatattgatctcagttcttaactagtgcaggacaatatggaagttggatgtgccaacatgtgtcacaaaatctgcaccaaatttctgttcagtgtatgttatatccaaagggaaactatcttcattcaggcttgccacccatgcaaatgcaaatgataccagcaaagaagagctggagaatatatctgaaaatcggccgctaattgcaaaaagtttgtgttactctaatgctaattccctttagatgatattcactctagtatacttgtgagttgtatgttcattaggtgcatgtggaatttgcaggtgaaccagcaccaataatacatattgaagggcaaaattcatctaggtgagctttgcatcctctctctatatatatgctaacataaattccttgatgttttcatggatacatcaaatatgtgcccttctcatacaaactacccaggttttgataaatgagtttttttttttatgatagtgcactttgtcctggctgcaaccctttatctccaaacctgagtgaagaatgtactgaatcaacttctaaatactacccagtatgcttttgatattttcccctactctttgttattttggttttgtcacttgcagaaatataactattagaccaactgctttttgcaggaagatttggaggctgaaataaggaagttaaagcttgagctgaaacagaaaaatgacgatatgcacatgtggaacaaggtaattgtgataccttgtgctgtgttgcttattgtttatctcataaagttacttgtctctaatcccatattctgaaagtatgaattctaatggaaatttggactgcagttacctcttgggatcggagacaggagtgaaaactcaaatgcaagtgttgaacatgaggatgaacatttacaagaattcacgacatgttcaacccattcctacagtgagagaccaaatgcagaaccgagttccgcagttcgtggcccaaagcataagctcttgaaactcgaaacttcctcttctgatcaatgcagagagagaaccatacaggaatttaaagaccatagttcccaggatacggtgcatccgatcttaagacgtttgccgcccaaattttactcgcctagaaatgattctaagcatggatgtgcttctgaaaaggcttacaaccttgaactgaagtgtaaatctttgccaaggccaattgagacgaaaagactactggagggtcttccaactagattccaatgcaaaatatacacaacagaagaggttgcaaatgccaccgatcatttctcaccggaactgaaggtaggggaaggaggttatggaccagtctataaagctacacttgacaatactcttgttgctgccaagattctccattctaacataactcaaggactgaaacagtttcaacaggaggtatgtccatggccaattttgtttgacacaagtatcccaccaccacaatctctttaatttccaatcaaatgagagtgatgttgggaacttgggatagatactgacagtaaaatgttttcagagcagcacaatcatattatcatttgattttggtaatattgtcactatagatagccagatacttctgttaagtcaaaatcatgtagacaatgatgtgtttacgtgaaaatttcaaatttcattcacaaaaatgaaaaactcaacattcagtaatatgaaatcatagagactattgtggtgcatccaaaaatgaaaagggaagggaatcatatgatttacttttagtcctttgctaaaaagaaaaacatcatgcatcagtttcagctatatataaatgatatatctgtaaaccatgatggtaagaatttaaattgtgttatcaacaggttgagttgttgaacaacattcgccacccgaatatggtgcatctgttgggtgcttgccctgagtatggctgtctggtgtatgaatacatgccgaatggcagcctcgaggaccgtctcttctgccggtcaggcaccccaccgctgccatggcagctccgtttcaagatggcagtggagatagccactggcttgctctatctacacaagatgaaacctgaagcctttgtccaccgtgatctcaagcctggaaacatcctccttgacaaagatttcgttagcaagatcagcgatgtcggcctcgctcgcatcattccccggtcgatggatgagacggtcacgcagtaccggatgacagatgctgcagggaccttctgctacatcgatcctgagtaccagaagactggattggtcaccacgaaatccgatgtttatgcgctcggcatcatctatcttcagatgatcactgcaaaagatgcaatggggcttgcttacatggtctctgatgcactggaggaaggaacatttgaggggctcttggatcctaatgtcaccggctggcctgtgcaggaagctcagaagtttgctgagctttcactgaaatgctgtgaactccggcacagagaccgtcctgacttggaatccgtcgtgctccctgagctgatccgtcttcacacattcgttgcatcatctggagataattcttccatcgaccaaggccaccagcgttcagtcagcgacaaggtaaaacaaaaaaaaggaaccatcttttctctgcaaattctcaaatgaaggcatcaggatatctccaatatgtgttctgaacttctgaagttatgggtgtttcatctagactaatattgttctactctaaatgcaggagttggctctggaaaatgacttggccgagattctgaacgatgggctagtgaagggggcgtcatttgcagcataaaagtgcaaggggccagtagatgttattctgtcaaagatactggaatctgcagtagttttgattttgctgtaaatactaccctagcccagaaatttttgaataattagatcatttgggaaacgtgtactaacaacaacctgtaaattgaacacaatctatagctctcatctggtagcactgttcacttctatcaactgccaatgggatcaactgaaaccgatttgagcaagggcttgagatcatgcctttatcaggatcaggaatgccagaaatcttttaccctgatatatcacattcttcaagactgttgtataaagaaaagcttagttgttgaactcgcaatatcacaatgcatttgccaaattgtgcagaaagatgcttttacatgattggatgacaaagcctatttcgttttgttgatcataacaagccaaataaacctactgttttgaatgatgattaagtccaccatcaaatcaaaccataggtgatcaataaattttctgttggcggcctgcatgattacatgctagtggtatggggggaaaagatcggcgatggcaccaaaggaagaaatcaccaccattgctctggtctctggtcccatcgtccactacagacaaacaacttccatgttgaaggcttgaagccaccgtttctctagaccaatgagaaaaaaatgatcaatgagattttttttttcatcacgaatttatatgagagatagtttagcaacattgacatttcctttcacctcatttgattttctaattaaaaaaaactgtaaaatttgtgttttccatatattatttagaaaatcgataaaaaaaatctagcctctatatctaaaccggatgtacacagccaaagtattttccacatttgtcccattaaaactcatcaacttaccaagaaatgtaaccattccccttgataaccacgccaaaattttattcacaatagtatgtttttcaagaaatagatttgaacccatttttatgtttctaaaaagggacatatttgaaacacccattttgttaattgttataaaggaaatggaaagatgcccatgccattgccatcccaagtgcaccggtgccaccttctcccagcgccaccacactctccatctcttgtcaccttgctctactctccccttcttaacctcttcacgccaccgccggccaccaccaccactctctactccggcgacatcatgttcatcaacacggccagcttcgtcgccggcgccgtcgtcgcttcgccggagcagccggccaagcttgtccgggatcagaggagggtggtgcctggctcctgcagggcaagaagaggtgcagcatccaatggcttcagaacttactgcatgcaggtgagcaattcagcaaacatgaaactttctctgcatatctatatgttacttttgttttgaggagtcgaaaaagatcagatcaaagtgttttcttttcggcatgaaatacttgcaaaatcagcttacagtaaattcagcgagtgatttaattttgttgtagacatggaaccctttcaccaacaggaggtacgaggcgatgtcttacctgcctcccctgagcgcgaagtccatctccaaggagatcgagttcatcatgtccaaaggatgggtcccttgcctcgagtttgacaaggtacaaactaagcatcaaacttgtcctaactctttttgtaattacactaattttctccatgatgaatttatccatcagttagtatttacccaaaagaaaaatgtattgttataagtttgtactatgaatggatgatatggtgtaggagggggagatccaccggagcaacagccggatgccggggtactacgacgggaggtactggacgctgtggaagctgccgatgttcggatgctctgacgcggcggcggtgctccgggaggtggaggaatgccggagggagtacccggacgccttcatccgcctcatcgccttcgacagcagccgccagtgccagtgcatgtccttcgtcgtccacaagccgccgtcggccgccgcttctccggccacggtcgccggagctgaatgaaccaaggtgttcagttcatgttcatcctcgcttcgatgatcatcagtcacagcatccatccaaccagtttccttcctcttcttcggtctcttgctcacttgcatgtgctgtaccacttctttcagttcaacttcaacctcatctttgatgactactgtgatgtactaatgttgcttcgagtataatgagcacaatgatgatcatagcatccatccaaccagttatcttcctcttcttcagcatcatcttcatttgcaggtgttctatgtacctcttcttccagttcaacttcaacatctaatctttgagcgatgtgatgaactggtgttgctatgagtatcatgtgcacaatgatgaccatcttatgatcatgagttgcttcagaagtttacttgttccttcccatcaactctcttcacaaatcgagaaaacaatgggtcacgggagtatcgaccaacctgatctgcacatggctttctgctgaccccatgaccaactgccgtctgccgagccagacaatcaatcatacaccgtaccgtacttctacagaaatgcaagacaaatagtatcaaacatcatacaccaggtacacaagtgaaacctgcagcaggatccaaggtccaaacctttttgcatgtgcacataaatttaacttctcaaacggtagaactagaaggcaagaaagtgcagtaggagacagtaaaagcaagggtctaaaccgaacataacattagtgcagacattttgcatctattgtcttaagaaaaggaaaaacatcaggactcctcccattccccatagaagtcagcagcacatttgcatttctttcaaccccagatacagcaccacatcatcatttatcctgacaaggcatggttagctcggattcgtcagtgtcgacacgaagcctgcttcatcccaatgtttcccggtacatcctgagaatcatccctccctctcacagcagctagcaacagagcttcaggtacccacacacttgtggcaatttcagaatgttcctaaagctgaccaaaagagcacagctcttgatgctctgtaccaacatggcggtacggataacagaactgtaaactatggactcctaagtgaaaaaacagaaataagttgctggataaattaaacctactgtcatagcaaataaagtagagcaatgaacagattgtataagttaaccgcttcaatgaaatttccaatgaagaatcaatgcaacgatctgctacgaaagaatgggaccaaaatatgctcccctacaaagagaacggtacgagctcccctctctttaatgccaaagttccatgcagaaaccggagcgaacagaaggtggccttttgctgtagatggcctcagagaaagtgtcagcaagctggccagaaaggctaacaggatcatcaataagagtgtttacgtagacgctgactatcttcctgtcatgaggggtagcacgaaggctataccaagtcagaaacttcactctgaagttggtctcaatgtaaccctcacattccagccacctgaccaccttaacacagtactcataagatgcttctgggcatccatccttgtggccgatttcctcacatttacctgatgttcttttatttgaagaattccctggttccctttcaggcttggaagagccattttgaaggatgttatcaccaggttttgctttcaagctcctcccactgatatccttaccattttccatatatctaggtgcagttggtggaatagagccagaatatcgaggtggaacaatcaccacctcatttccagcaggagcatttgatgcatcctgtgatccaggaacttcgcttctctggttctgctccattgaatttgaggattctctaagtaattgtgtttgaactgctgaattgggctcctcgtccaaagctgatgctgagagtccaggagcttcctccaatccagatacctccgtaaccctagctacgaccatcggcatactctgtgagttgtttgtaggttcattggggtgatgacttgctttgtctgaatcaagtatctcaggattttcacaatattcaaaatcactttctggtgatttattgagatcagcatacaccgcagtgttattatttgagtccacaccttctgaagaaggatcagactgaccaccactgtttgcctttgggctcccattgttttggtctagcccagacccacctggcatcaaacccttcagatcaacttccttctgacagcttgtcttcattttggcttcccacgatccaaactccttgtagttactgaaggcaactaccttgaatatatagcttgtagctggcacaagttgagtgaccactaacgtttttaatggtgcaagtatgatgccagttggacttgatgagaacgagcctgtggctgccactctgtgccatacattaaagcatgttacatcttgagcaagtataggacccaaatccaaaactacagtgacagatgtttgggttatagcttcaaactttacgaagtttgatggtatcatccgtgaacctgaaaatgcacatatgcatgagaattcaacactatttgtatgtatgtggtctaacgtgaagcacgtggaaacttacgttgaaattgcaagttagaaggagatccacaaaacagagactccatggtttctattgctcgagcacaaagtttctgaacttcagcaccaacagcaagccggctcacaattccacgacccatatttgcaactccagatataggaccaacctcagcctccagtttcttcatcgctgtgtcaacaatttcatgcaaaaccaagtacttctccgtggagacaagaatcttatgactcaaaaaaatccgatgacacaatacatccaaccggcgagcatctttagctatcaccagttgtttcttccaggacctgaacaaggcattaaacagtcaagtattgctcggcaagctaatttactgtttcaatatccaaactcttgaaaggagcatagttttggaaaatgggccagtaaacttgattgaattacttaagtgcattgtgctggactggccaaagaatcttgaactctaaataacatataactggttcaaaacttactactacaagatactaatagccaagcagattcttttgagaaagacaattaatcacttgtcttgtagttcaaaacttcaaaatgaatcctatttcccaggttactcaaatggcttataaacatgcacagacaaattagagactccttgcatatactagtctaagcatttctccatgatctattcatccttgaaaatattgaatccacctggcctcagtgcctcaccaagttttactggcttagtaacttggttcataccctgaaacttgaactacaagaaccctatggaatgcaacacaaagacaccaaaatgcagtcgaaagcctgttttcgcagctcgcaacctatgaaaatagggttatcccagcaaacaaatttactccagatggagaaggaagaatccaacactaattcagcttaatgcagaagtaagcacacagaccacaagctcaaagcatgaagctgaagggcaaaagcagccaacccacttcttaagacacaattgagaaatatgcatcatatgattggaccaatgatgatgacactacaaggatcttcaccgaagaatcctaaaaacagaatcagtaaggtaatcaaagtggctggaaagcaagaatgcatgcaaattatcaaagctaactctcacaaaagtcaaactaacatatttctagtagttatcgttgcaataaataatggtaacattacttaaggcagtaaaaactggaggcataggaataattaaaacataatttcgtatagttacagaacaggaaaaaaaactgtgcaaataataaagttgtttagggagaatacccaagcagatcattctgtttccgacagcgagtgcagtaataaccaccatcaagtttcttgcactgcccactctgcatgatgccagttcttccatccttaagagcacattcaagatggcacgaaaatacacaagaatctttctgcaagggttgatctgaactacagaataaccagaggctaggatccttattgtcatcgtacttgaaacaaatacagcatgaacagcgtctgcaaaatttatcttctggattaagagtcgctctgcaagctaaattgtggcagaagcgagcattacttgctggcctgggtatttctgtagttggactgcttgcaacaattggtagtcgtgatgggttgtcactctttcgctgccgtttcgcaggggactgatggttggctgtgttgggttcaggggtaggctccttctcttgcacatgctccacaacgccaccaccagatgatttgccagtcacaactctgaagagatattccaacattctctgcttcgataatccagtgtacttcctttcccttcctaaatcagcacaaagaatctctacaatttcacggcgactccaagactgcagtttgtcaggagcactttctggccgcttcgataattcacggacaagttcccgcttttcatccacactcatcaatcggcatttagcaggatcaataggtactcctaaacaagagaacactggaaactattattatcaatttgataaagtcagaaatagttacaaaatccagtcggacaagaagcaaacaacgaaggaaatttagacgttcattcatatttacagtccagaatggaaaggtttaaagttcattagatccagtagaagaatacatattttgaaggcatcattctttctcttcttcagaacaactatgagacggtactgagtaacttagcgtgcaaggaaaaactcaatgaatgacgttccaaaggaaattaaattctcgacatgctgaatcaaattaatgtgagtagcacactgtcttactggagtagaagtcaaattataattatagcacattgcaacagaataagtcttaacctcggaaaaaaaagatgattcggtcaataatctaagaattaaaggctcatcaacatgtaccatattgtataggactaaatgtgaactacaaagcacagttgtgataccacaaggcgcaatgttaactagagctatcgaagctggcacgagccgcagaaagtcaactctctacagactgtctaagggaaacgagaaaactaaaaagaaatgagtctttctaattttggaccactaaacaaagaaactatcatcaatcatataacccctaaacgtggtaaccttgacatgcaagtagacgcagctcctctagaagatataatcgacgtatcagccaatccttaccatcaactaacagcaaacaaacccgccttcggcagccgtgatcccaccaaatcagcaccaatgcaacacccaacgcacgaacaggaggcctcaaacagcctaacgccatattattttcccgtcccaaaagaggataggctgctgctaccaacgcccgcggacgtaaatcccacgaaaacgacgtaaagccgcaggaaccactccgctgccacctcccccggtagagagggggcgcaatgtgagtacccatcaccgcatgcagcggcgaatctgacaccagcggcatcgccatccaccctccccaacgcgcttccacctccacccctctaccacgcatcagctacagctccaaatcaacccaacaaaccaatcaatgaacagtacaaaccctctaccgccgcaatctaatccacgcgcgcataatctaacccatccatccatccacacaaaaagtctaaatctcgacgaacactacaccaccccccccccaaaaaaaaaaaaaccgcctcccaccctaaaatccacgcccacaaattcctcctcctccaccaccaagcccgcaattacaccgccggaacagcggattcgtcgccggaacaaacagatcgagctccccccgacgccgccgcgagacctgagccatcaccaccaccacacacacgcaacaacaacaacaaaaaaaaaaaacaaggcgaaaaccgcggatgcgggggcggcgctgaccgacctgcgtagggtggatccatggcgaattggggatcggcgagaggggcggatgcgcgcgggagagggatctcctcctcctcctcctcctctcactcacgtggactctcccctcctcttccaacctctctctctctctctctctctcctcgcctccgcgagtgctctgctagttatctctctctctctctctctctctctacgcgaggttaactcctagccttaggcgtccgcacgcatatcaaagcctagggtgaggtgaggcttttgcggtttggtcctcgggttctcgcgtattcggtgatgggtcccgactccagagtgattagcggctctagcggtcaacgaggttggttgttggttaggcggctctacttggggtttgttgggcaaaatagtaatagtggtatagttcgtgttcatagttcagagcttcaaattagcatacattgtaaccaagctaacaagcttgtagtatgataataagagtaggttgagaagtgtgataatatcgagttgcggtggatctagggttggatgaggtctgacatgtggttgggctatgggtatagccggtagcgctgtacaaccaaagttgtatatttcgatctcttggtattgtagttgtaagtgtcacacagctggagttcaactgtaccaaacatcttgtagatttttgtcgcgttgattcatatttcaattgagttatttttaggtcatttttgtatagtttacgtacaatataaacaaaggcttataggatcgcacgtaacaagttgtagggttagttgaaccaaccgtttgtgtgtaattagatccgctaatcaatattaaatgtagtcttcgcttagctaagctcctcgacatacatatacatgataaagtgatacatactaccacataattcccattcttttttttgtcacaaatatgcctgtagtgtgattatagtaaaataaaacacatgaaaagaattgtatttggcagatgacattgataattaaaatgacatgtatctaagaccgaaacaaacaatatgccattttgtaaagggtgcattcagctaacaccaatactatactatacacaccgtcataatcttcctcacaaatcataatccagtggatctacatctactatagtactccctccatttcaaattgatctacatatttcataggtacaccaagaccaagaaaagctaataactctctcatactatatttattctagaaacaaactcaaacaccatccccactatttcctagccaatagcaaatcaagatattgcatgtgtgttataaatacttgtgtgcatggatgcatgcatcaatgtctatttactccaatgcacaagtaacgaatagacttaataaataagcacaaatatgtagatcatttaggaataaccttaaaaaaaactatatgtagtcaatttggaatggagggagtacaatagtatggagtaatagtgctagtataaagtactagaataaaagaatactttatacattagggtatataagcataatttataacctaattggggttgatggagaaagaaaacaattaattaatcgtgaattaccaataaatcaattgattgattactctaggtttaaaggcgacggagaacgaggggggcagacgggaaaagcggcaaaaggaatcggaatccgacggctgcatgcgtggggcgggcgcttacgtggccaccgcctccgccgcccgcggcacgcgcggcgaacggctaggcgcttcaagattcgtgcggcctcggcctcggagagaggggtgggcatcgtcttccgagctgagctgtcgatcgccattattaattaattaattaattaactaccactactgctgcagttgctgcatgcagtgcaaacgcctttctccctttcttttattaagacctcacttggcaattttttttgacctaggagtatacttaagactaatgaacaatcatttcacgaggagtattttttagagaaaattttatgaatattctacagctatattgcagtgtactccatccgtcccgaaaaatactcaaccaaatataacccctcctaaaagcaggtacaatagcagactattagtcagctataaacatattttaatgagataaaagatgagagataagagaagcagtctacagatctgtagccagctgtagcacggactccaagacacagtatgtgtatgacaggtgagaccatatattaatagtatagtaaacaactattgtatgaattagctattagattggctatagataaattggagctagtagtgggctatactattaaacttgctctaatataactaatctgggcaaatggttagagcttaggttttagataaaagattgtctagatttgtcgttaatataagtcgtttgtaacaaatatctaaacttgtcaagtttataagtcgttttggatttgttttaagccaaaaactcctcaaattcgaccaggatcacaaagaaggtgccgacatttctagaaaaatagagtaaagtgcatgagcagtccttagagtgtcatctaggtccccaatctcttaaatgtaaatctagatctcaaaacttgttaaagtgtcatataggtctagaattctacatggcgctgatatggcataccacacgaatgtgatgtagcataatcttgacttaaaaatgggacctacttaaaaaaaattatttttcttctccttctcttatttttttcatttcttctccttcctctcactaaaaataggctaccgccgcatggggtactcaggtcacagagaaaggaacagaaaaggaaaaaaaagagaaggaaaaggaaaagaagaaaaaagaaaaaaaataagtgggtcctatttttcagtcaagatgataccacgccacatccatgtggggagccccacgtaaaattctgaagaggttgtggcgatttgagacctaaataacatattttgataagttttgggactttggatatgtattttgagagtttaggaaccaaaatgacacaccctataagtttaagaacagtctgtatactttactcataaaaatacatacaaatgatagatataactaaaccaatctaacattgtaaacgttattatattttatataaaaattagtcaaacttgaagaaatgtaacttatcacgaacccaaaacaactttctacaacgacgagagtatattttcctcagaacataaaaggaagtatggacaaacatgtctactgcacaacacaaaacacagtgatgtataataccacagcgctagtagagtactttgcaggcattgatgctatagggcggtccagtgtagtacggctgtgtttagttcaccgcaaaatttgaattttggttaaaattagagatgatgtgactgaaaagttgtgtatatgacaggttgatgtgatggtaatggactgaagtttagatccaaactctggatttaaacacatgcgtacgtagagagtatcacatggtggtacgtacatggtgcaggcaagtacgtacagggtacgtgacagggggaaagtcaggttgggggtgccctgtagcatgcatggcacggcatggatgggcccatttcgccagtatgccatggcaaagctttaatatcggtcgatattttactacaccgtgtcttttgttactgatatatgggtccagcgattatcggtctcacatgtcagtggctttagttagagcaagtataatagtgagctataagcttactataaacttatgtggaggagagaggtaatgaaaaatcaaagatgttggctcttatgcaagagctagcttatcacaagttccaagacaaatacaattaatttataagtgagagatatggataggagaagaaaattatagccagccttatagataatctattatataaaatatgttggtttaatatctccctacttgggttggcacttggcagcgtcgttttctgttgggatatgatccgaacagaaaagcacacagggaagagagagagagagagaggagagagagtgagcaaaaagctctgcccttttggaaaggagtatctcatccggtatatatgtttttgcgcaactagctgatggatatagtaacacggacatataccacaagtgatgacatgagagcatcgggtctaaagcgtgtggtttttttttaatggaggattcgacggattatggtttatggatagttaattgtagagatgaattaaatgttgtatagcatgtgtcggtgatatggggccgggggtatcgtgactagaggcttgggtagccgcggtcacccacgtggcctgaccccctgggggggtcgggcccgagggtgacgtggccacccctccctctgtctccccgaggggtcgggccgctcccgtttcggccccgagggctggggcgccctgaccccctgtggttttggcgccacgtatgtgggttaggtaagcacagcgggctcacctaaccgcatttatagcaggttggacgagcgcgccacgccgcatttaatgcggcgcagcgagcgcttatccggtccgtgaccggtcgcggtgacagaccggtcagatcgcgggttaggtggcaacaggcggcctgtcacacgcctcgccccgtcccatcggaatgatgagagctacctggctctcgtccctagccggagccggcgtgctaactcctggagttggtatgtcagtcctagtcagatccattccagacttcagcgcaagtatggcaaggaagtcgctggccattaaatgaaggttgaaatgggcgtccaccggaaaagcgggcgagcgaggcaggaggcgtgtgctctgcttgtcagaggtcacttccggctgtagactagccctctttgtaaaaagcatgtttcccttcttaggcagctagagccccatgtggtgacccctgaccagataaaaaggaggcccaggcctaggaagaggggggttgggactctggcgagggggttctagagcctgaactctctctcgctctccggctctctgtattccttcacacacagatccaccagaacacaggagtagggtgttacgcttctcagcggcccgaacctgtctacgtcgcccgtgtcttgtgcactccctctctcgcggacgttcctcagatcgagggcgaagaacctcacttagcgcccccggccgaaccggcaaaggggggcctgcgcggtctcccggtgaggagccccaagctccgtcatctggcgcgccaggtagggggcgcgcgtgtctttcgaagccctcgtcctctttcgtgtgcgccaagcttcgcccgctcagcccaatggccgaacgggcagtggcgcacagcctctctccgaacgctagcggtgacgacggggagcagaacccgcgccgtcgggctcgcaccccaccatccccctctcgccgaaatcttgggcggggggaggcgctcaggaaggtcggaggttccgcgacttcgccactcgcgggcgacgggggaggacggcgagacggggcgcgtcgccgcctcgtctacggcgatggcggcacgccccagggcgcgctccaggctgcgggcgcgctcctgcgtcacccgcccgtcgtccccgatccagagactccagcccgacgttggctggatgacgtggccgacttggtcatgacggcgcagcaacgcctaggcgccggcgggcggtcctccgccaccgaggcctctggcgctgccgccgccggctccatgtcgtcgaggcggagggcgcggcgagcggcggccgttacccgccgttcgtccgccattccctcgtcaacgcctccgacccaagaagatgtgcgtggggggccggatgcccgcctcgatatcgagcgccggcgcgacgctcgtcgcgccgcccacgcaacggagggcgcttcctcgtccggagcgccacttcggtccgggcacgggggccggcccccgtgtccccggttggcggtgccggctatcgagcctttgtggcgagccttcggaacgtccgttggcccccaaggttccggcccaccatcaccgaaaaatacgacggaagcgtcaaccccgccgagtttctccagatctacacgatcgggatcgaggccgccgggggtgacgacagggtcatggcgaatttcttccccatgaccctgaagggtcaggcgcggggttggctaatgaacttgccacccgcgtcggtccactcttgggaggatttgtgccagcagttcaccacgaacttccagggcacatatctgtgcccaggcgaagaagcggacttgcatgcggtacagcgaagggacgatgagtctcttcgcttgtacattcagcggttctgtcaagtccgcaacaccataccgtgcatccccgcacacgcggtgatctacgcgttcaggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccccgggtccgccgctcggtcaggacgtcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccggcagggagcgcccgactggcaagtggtgtaccgtgcacaacaccgccctccatgacctcgcggactgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgctgaggacatcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaggttggggcgtgtcctcatagacgggggtgcagccctcaacatcctttcccccgcggcatcgaggccaaccccgagaagatacgagctatagagcggatgcgcccccccagcaagcttagggatgtgcagtgcgtcaccggctgcgtggccgccctaagtcggttcatatcgaggctgggagagaaggcgctacccctatttaagctcctcaaacgctccgggccgtttacctggacggaggaggctgagcgggtcttcactcagttgaaagcgtacctcagttctcccccagtcctggtcgccccggagccagatgagccgttgctactctacctggcggcaaccccgcaggtggtcagcgcggcgttggtcgtggagcgcgacgaggacaaccctcactccgcgcgtccccaccctgtgtcgactcgacccgggagagagcagggaggagaggcccccgaaccgaacggcggcccgaggcccccgacggccggagctggccctccgcctgcttgtccgacggtgccaggtgcccccgacccccagaatggcctcggggccactgcgggaaggccgcgcctgtcaccctctgaccccgaggtcgtcggcacaaaagccgagtgcgccccgcgtggcctctcggacgaagagcgccctagagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgctgactttgtggcggagtggaccccagctcccgagcccgtctccgcccccgaggctagttcgggcccctcgcagcggcctcacaccgtctactgggtgatgcagttcgacggctccctgtctcttcagggcgccggtgcgggggtcacgttgacctcgccgagcggagacgtcctcagatacctggtccgcctcgattttcgggcgaccaacaatatggcagagtacgagggactccttgcgggactcagagtggcagctggactggggatccgccgcctcctggtgttaggcgactcccagttagtcattaaccaggtctgtaaggagtaccagtgctctgacccgcagatggacgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggggacggacgcgcctgaacggcccccgaggcccgtcggagtccaggcctcgggacccgaggggagcgctcccagctcccctagattgattgcttggatcactgagatctaggcgtacctcgcagataagactctacccgaggaccgcgaagggagtgaacgcgtccggcgcatctccaagcgctacgtgctggtggaagggaccctctatcggcgcgcggctgacggagtcctcctgaagtgcattcctcgggaacaaggcgtcgagcttctcgccgatgtccatgaaggcgagtgcggagcctactccgcctcacgcaccttggttggcaaggcctttcgtcagggtttctattggctgacggctcttaacgacgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcagaggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgggtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcatcgcttctacccctagtgggggtcgggtgtcatgtctcaggctcgggccaaccccgcacccccccgggcgtgcagggttggccgggggctaccacatgcatatactcaccttttttctcttccgtatttcaataaaagcattttcgatttcctgaggactgtgtctgtgccatcgtttccttttgaagaatcttggcttgaattagcacgctcgtgctcgaccctgccctcggtggcccgggtcggctaaaatcgccaaacggggcccataaccgagccgtgccccggggcatggtgaactccggggggaatcggcaaaggcccacaatcgggtcatccataaccctcggtcaccgcgctcccggcctggccagtctcgacacgaggatctccccaggcactagccccgacccgcgccgtttgaggctgggacctgggcacgagcccttgttcaagccaagacatagaaggaccgcggcacagaccatcctcgtctcatacacacaacaaacagaactgacgcagaaatttcctctttacttgattacagatcaaatcagtctatacaaggagggggcccgaaggcctcggaagaagaagcaaaagttattaagattggcgggggcctgggggctcactccgacgcgcccgggtcgtcggcctcgtcgtcgctgtcgtccgcaccatcgtcaccgccctcctcgtcggagtcgagcgcgaacgcgagccgaggggccgtacccttgaagctgtggacgatgtggtcggcggcgtcccggacctgcgcgcgcgcgccatcctcggttccgggagggaactcttccagcgctgcccacggggagaagtcagggtccctggcctggtagctcgccagtacgagctccaccgcccccccccccccgggcgaggtccctcgaggatgacttgatcgtctcctcgagctcctcgaggagccgctggagggccccggccatctctgagaggcgctaggcgaggccctcctggttggcggcgtacttcgcgtaccgcccgccccagaggcccgcctgccacccggcacggtctagacgggagacggcgtcccgaagcatgccgggccctacttcgctcgccaagaggagggcctcgacctccccggcggacgagtccagcgcgccctgcagctcggcgatggtgtgttcggcggctgcgaggcgggcggctaggtcgccgtggcccgcggccgccccgccactgtgcgccctcgcgtctagctccttcgcccgcgcctcgagctcagcggcccgctgatccagtgcggccctctcggcgtgggcgccttccagattgcggcgcgcctgctcctcccgcgctgcctcgcggaggaacaggctgtccgccagccgctgcgccgcggcctcggcctcctcgagagctcgcccccgctcggtgagcgcgtcctcgcggaggcggagtgcggactccttttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttctcgggcagcggcggcgtcgagcttctcctctagctccgccgcctggctcccgtattggaggcggaggtcgtcccgcgcctcgtcgagcacggcggtggcgatgagggcagtctcccgctcctcctccacctccctggcgatctccgccaggtccctacgacgggcctcgatctgtgaggcgtgccggcggtgtgccttgcggcccgcctccaccatggcctccaccgagcgccgcccctcctcgacgcgcgcccacgccgcgtcgagctccgcctgctccgcctacagggcctccatctgggcacttaacccgtccagcactgtgctgttcgcggcggccaaggcctgcaggaggggctccgcgctcagtggggcagcggaaggcagaggggagagccgcctcggtgtgggtgccgcgcggctcggcccgccgatcgacgtgccggactcgggggcgtctcccgaagctggctcgtcccaaacgtcgcccgaggggtcgggcccgagtggcgcgcccgcggcctcgtcgtgggtggcctcggaagtcggcgtcgcctcgggcggagtcgggtcgggggtttggcaggccgcctggcgtgcgcgcgccgcctctgcctcccggacggactccacggcccagcggagtctggcctcctcccgagcggcctcctcagcctggcgaacacggacggcctcctgggcagcctcctcggcttcccggaggcggtccgcggcttctcgccggtcagcttcccgccttcggacctccgcggtcgccgtctcctcggcctcagaccggccggacttggaatggcgggggggggggggggggggcgacgggatctcgctgaggcagaagaaaaaccagaagacaaaaagaagcgggtgagtgaaaactcgccttgggagatgggagaatgaatacggccgcggtgggcgcggggacgaacctgcgggaaggtcggctaaacgaccacctcgggggcgagatgaggttcccccgtcatggcgcgatcccccccatcttggggagccgtttcttctttcgctccccctcgggctgcggcatcggcacggcaccctccgggcgcctgctgctagcacgcaccgccccgccccctcggggaggagatgggggaggggttccctcctgcttcctcttcccccgggcgtcggcagggcggctgctccccgggcccccgtcgcggggcccaaaagcacgaccccctcccggggtagattgttcccccctgcggctcccgcccgcgccatcgtggccccggggggcccgctcccccgacgccccgaccacctgcatgatggtcaggatcttggcgcgctctggatcgcagcagagggggaggaccccttgggggatgagggatgcctccacggagctgagattcagcacccgttggaccaccatcctgaagtcctcagggtcccagtcccatttgcacccctggtgggtcctcatgtagtcctcgggcccggtgtactcccaggcgccccgggcgcgccgctggagcggcgcgatccggcgacgaaggtagtcgccgagcaccatggcccccgtgagccccagggatcacagacccgccaggcggtcaagaatggcgtcgtagccgtctcccagatctaccaccgcccgccagctggaggcctgcgccgggggctggctcggaagtcggaggcgcgcttcgtcggcgaggggggtgtagaaccaatcgctcttccagtcgtcccactttttgtggaggacgcagggaatgtagcggttcagcacctgcccccgcggctggaagtagcagccaccgactaccgtcggcggcgacaccggctgtacggtgaagaaccaccggaacaaccggagagataggcgcaccccaataaacatctcgcacaggtgtgcgaagatggccaacgtcattatcgcggtgggggtgaggtgcgccatctggagatcataaaactccagaatatccatgaaaaaaatagagaatggcgggaccagccccgccattgcgaaaaagaggaagaagacggaccgccccgggtactgtggcgccgggcgtccctcgcccaacgcgaccacctcccggccggtggcagattccggcatgaatcggcgcggcagcccggcctgcctctcgctcacgatgcgggaaggcggcagcacgctaccgtcgagcggtgcggagccccgtgccatgacgtcggcggaggaggagcttgagagcgagcgagtgcggcaagggtagggcacaggaaacgaagagttagggcacaagtggcgaaggcaaggggaagagtggcgagaggaaagaaacaaatcccttcctcggcgtctttacacccttgccaacgctatgcccggctcctcgcttcccgcgcccactacctcgccccctcgtttctcgcgcacacgcctccactaaacccactcgcccgtttgcggcgcacgtggcaaatgtgcggccgtggcggttgagatggggcagatcgtgcgcgcattaactacgcccgccaaccgtgaaaagcgccatcatcatgtccccaggcgaaacgaaccggctcgtcccgattcgcgcgctgctcgagtaatgtagcggtcttaaagaggccgctcattatcgtcggtcggttttcccttgccgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccgggggtatcgtgactagaggcttgggtagccgcggtcacccacgtggcctgaccccctcgggggggtcgggcctgagggtgacgtggccacccctccctctgtctccccgaggggtcgggccgctcccgtttcggccccgagggctggggcgccccgaccccctgtggttttggcgccacgtgtgtgggttaggtaagcacagcgggctcacctaaccgcatttatagcaggttggacgagcgcgccacgccgcatttaatgcggcgcagcgagcgcttatccggtccgtgaccggtcgcggtgtgtgaccggtcacagaccggtcagatcgcgggttaggtggcaacaggcggcctgtcacacgcctcgccccgtcccgtcggaatgatgagagctacctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcaaaggtcacttccggctgtagactagccctctttgtaaaaagcatgtttcccttcttaggcagctagagccccatgtggtgacccctgaccagataaaaaggaggcccaggcctaggaagaggggggttgggactctggcgaggggattctagagcctgaactatctctcgctctccggctctctgtattccttcacacacagatccaccaaaacacaggagtagggtgttacgcttctcagcggcccgaacctgtctacgtcgcccgtgtcttgtgcactccctctctcgcggacgttcctcagatcgagggcgaagaacctcacttagcgcccccggccgaaccggcaaaggggggcctgcgcggtctcccggtgaggagccccaagctccgtcagcatgttataaaaaagtttcgaacaagctgtctaataaatggtgatatagaaagtgcttcaagttcttaaagaattgtaattcgagaaccatggcacagaggtcccgtttgaatgtaatgaagataaaaattaagtgataatacgtaaaataagaaagcccttaatgtgagattaattaagttgtaattattataaactaaataggtttatcttatattttaaaacaatttctacataggaagtttctgcactaaatacatttatttagcagtttgaaaaatgtgctaataaaagtcgaggaaaaaaatctgtatcttaatcaagttgacagttacacacatgtcaataagttgaaaagaatactccagcatggaacttgtcaaagggggagggggatctagacatctagtagtctcagtgttcagcttcaagtttataatctcagcgttcatcgctttcactacatatagctctattttaattactgttaaggaggcaagcaaagaaatctatgtaaaattaaacctttaaaatttagaatcagcatcagcaacagccgaacaagcataatcaaaagaggaagcgtgcgttagggtttggaatcgtgatccgggaccggggagtaaggtggtgtttggttggagggactaaagtggagctaaactttagtccctctcacaaaaatgccaacttgttgctgtgagaactcttttaccggtcgctttggtcaggcatccaattagagggtgtttgcaaccctctaattgcaaacaccctctaattggatgtctgaccaaagcgaccggtaaaagagttaagagagcaacaagttggcatgtcactttgtgggcaatcccaatcgcccaatcggtcacatttttgcgttgtttaaacattgccacagcaacgtcactatcgagaggtacaactagtacttctactactactatggataagcttgaaggaaaacggcttattggacccagttctgatatttattatttcgctccaatcctagcagcataaccacacctaattaggagatggttttcaatcatgcagaatgccatggatttgtggtgctttcatgccatcctctcaagtttttctaaaagttaatttgaccgccggctatcaagataatccaatggcaatcaaagaggtagatgagtggatcagtcaaaacatacaaaggttagtcctaatccagaaactatgaactttcactggaagcacctcagaaagaccaaatctttaccggtggtactttgcagagaggagattctgctttggaaccaaaattggatgcagatctacccaatgattgattctgattgcaccctaaacaacccaaaaaaaaaatattagccaatcacaacttttggcctcatagttagctgcaaaatccagtcacaacttttgacttcagaagttatagcagctgcaaaatccattgaagcaaatctccttacagagtactgactactgagtggtgctgaaaccaaagaaaatgctagtggggaaaggatgcctccacctctatttacatggtgggtacagaattagatgtcaccatgggcactacagttttaggtcctgtctgtttttctgccttgtaaaccagcagcagactgaggaacaacaaaacttgtgaattgtaatgctactactccaaatcccttgcaaaaaaaaaaaatctgcattagtcactaattttggaagtctcgtgtcactcgtgtacccttcagcagttcagctagttctccacgacggaattcatttctaccacacaaacattagctggcaaaaaaatcaccacggcagccaagaaactggatgtggttactccaaatccctgtacttcagaacatcaatcttgtccaaatcatatgcctgacaaatcctcgaaatggtatcacaatccaatccttcattcaattttctgctctcaaggaacccatcaagcttcttcgaaggctgcaaattctattgaagaaataacacaataagtatttcttttttcaaaaaaaaaacaaactgcacatacagtaaatatgatatgatatatatactgtcaaagcctaacaatctagaaggaattatcagtaggctagagtcacaagccactattgcctaacacccccaacaaccactattttcacctaactaatgaaaggaccatgtatgagaggaacacatattacaaacaagatcatcttatatgatacaaataatggaactcccctcccccatttcctccatagtagctccttcataaaatgttgtggacatatataaatcccgtgaggtagaggatctcaagttatgttgcagtaaaaacaatatcagattcagattccaacagcaaattacaacatgttgtggcaaaaattgttaaggtgactagttggagttgtgaagtaactggcaacctttttctgtgagccacaatgtacagatcctccgaattgagattacacatagatgcataactggctgcacagacagcctaatcattgttgtatataagtcaggcaagcttcaatgtgcccatcattcatcagatgtataaaaagttatattatataaaaaccatataaagatatattataatagctggcttcaatgattgcttaatgattgcaacatgaagtcaggcattccagaaagtgctcaccagttgtatgcaaatggagtaactattaaataatcaataactacaaataaatccatccatagtcgtggccacccatgtgtatgtgcaggttgggcatacaatgcatgcagttatgcaagggtacactgacatgtcataaacctcaaggtcaaacaaactgtgcctagcgggtaaaacaagccagcatatatgcaactgtgcaagtagataaattcttttaattggcatatcctggcttaacttgtttgtgcattatcccatgcggccacatgtcagaaaaggttgttcattgccttcgggtacatttgcatactagaggcagtaggtatgtgatagtaacacagattaactacctcaactcttcaagtatctgatctagaactgatgtagtatgtccgatctacaactctagttgaattaacagaaaataatcaagatgatgactccggaggtccataaatgtctcggtccaaaacttccctcaaaatacaacaatctgaaggtttaactcattttgaattgagacaacttacccaaggagcatattgagtgttttcacaagggttgccatcctttctggaactcatctctttctgcttctcaagaaggattttccattgatctgagctgtcagaaactaacaactggagcctctcacttccctatgtcaaagtaagtatcaaacataccttagcaaacgccacaccacgacagagaggagtttgaacaaaaaaaaatccaagagctgaaaactctataataactgggccatctaacaaacctgcagagctctccaatgagaataagcacgaaacagcacccagaaaaatggtatgtttggcaaaggcagtacctgcaaatgaataagtaggtgtataagaatgaatgtcatctcaccatagcatagtgagttaagtacggattgcacgcattagaagttttcataccaacatgtatactctatttcacaatcttttttctgctatgaatcctatggggtaaagtacaacaacacaagaaggcaacatacaatcacatcctttgatcaagtagattatgatactctggttaatgattaaaacataagaacctaccgggtcatcaggattcaagtaatgtgtgctaggttataaactagacatcactggagcacaatctcacaaaattataattatattgtatggctcattaactgaatcagaagtgtaaattatacctcccacatatgtaaaaatcccttatctttaatgtgtaaatgagctcatcatatttttcttaatttgatgtactaagttgaaaagtagaccaaacacaagcctcaactaatattgtgcgcaatctagcaaaggcagcaagcaaaaataaagatctaataatctttttagtttggtcaataattgatagcatcgcaaaatgaaaaaaaaaatcccttcaaagtacaacaaactgatcccactgaaatcactgttgcaaattgctagccaacaccattttttccaaagcaaatgaatatagacttaccatgaaaacacttgtaactggaagcaaacaaactgagccataaagaaatttcctgtgaactgatgcacccctggttctcagaaacattgcagaaacagaagggtgaggaaagatataaattgagctatacagtaacaaattgttggagcaggtccatcaaacactcacctgacagcaatatgccgcaaccgtcgacgcacaagacgaggatttatactgcaattaaagctaggattcagaaataatcttgaatagacataaaataagacatgagtaagaaaattgccgaccaactctgtctggtgatgcttgatagtgccagagcgattcataaagctcaatagctaacttctatacaaaaacaagcatatgcatgaggctttccaagtaacttacgaagccagtaaaagaatagttcgtgtgaacaagtcttttagagcttcttctgtgcaacaacaggcactgacacagaatctaccattttacagttacggagcacgcacagaggttcaaaaaacaagcagctacaagctgtgaagaattaagacatacatttttacagcagacttacaatacgcaaatcatgcaatttcttaggccctgtttggtagagctccaactcttaaatttagctccaggagttgggtctggaatggacccagctccacctctctagttcattttgtgagagcgctccacccagctccgctcccatttcaggtggagctgaaactgtttggctgagctccagctccaggagaggtggagctggagctgtgccaaacaggcccttagaatagaaggactttcaactactttgtcccaacaaagttcttgaataacagctatgaacagagaaagctggtgtgaattgtgtattggaacggaatgatagagatgtcagagtcaatgctcaaacttgatcagatataacccatgtatcgctacatgaagcatactgaaacttgtatatctaaattagtatctgctcagacattctaatagttccattcattggcgacaatgtgtatccgttaatgataaattgctattgcaagtaagctaagccactaacgacagatactgtatgatttcctgcacagaggctcagagccttaggaaatattcatcacaacaaggacccaaatagttgaatatcccaatcgattcgacaatcaaactaagaataacaacaaaggtgaaacgacacaaattgcacgcacattttatcaaacacaaacaccaaactcataagcagagctcaccttgccggatgcacgatctcgagtagggagacgtccttggtcaccgacttgagcagcacctccgacggccgcacccgcgagagcagcttcagcccgaagctacaccacaacaaagcaaaaaaaaaggggagcacacccaacgactcagcatctcgccatttccgactccacaggcgccacccgccactaagcaatccccaaacccttacactcccgacctgtggatccggttcttcatcgacccctccggcgcgctcccgaacccgatccacgcccggttcatctgcggcagccaaaaccccaccatcagaaaccccccaaatgcgggcggcatgcgagaatgcagttaaggcgagagacgagaaggcgctccccgtcgagtcgagcaccttgtccgcgacgaagtcgacgacggcctccgcgttctccgacgccgtgcggcccccgccggcgatgccgcgccagaggtccttgacggttggcggcggtgggggtagtagggcgcccccatcgccgcccccgcaagcggcggcgggcgcggtggcgcgcgggctggcgaagcaccaggcccttcccttgacggggaagacgacgacgcgggcctgcatcgcagacggcggcgtggagaggtggaggtcgtcgtcggcggcggcggcggcgaggcggaggcggaggcggaagagagtggaggggttcggtcgaggcggctagcctagtgtactagtctagtgtgatgactcccacgccgcggcggcggggatctcagccgttggatgcggatctgacggttggatgtgcctattatttaggagtatactactgatcctttgtaacgaaatgacagaaaacagcattgctttgttattaccggattgaagtgatccgaagaacagggcgcgctccagttcagtgcaaaatatatcaaacaattttttgtggtctttgctgaaaataatcatatggttaatgaatgttgatggatgaaatgcatcctggtaatgaaaaataaataaaaatcattttttcgctaatgtcaattttcgacgttaccaaattttgataaggtaagagtggttgtgtttgggttaataccttactaacttttggaaggatttttacgagtgaaaagtaatataattacccaaaaattggttgggttgagttgacaaggtacgtgtagttcactgctacctctgtcccaaaatgtagctacctagtgatgcccgtactaggtagctacatttttgaacggaggaagtaccttacaaaattttggtagtattaccacaatttgaaaggtcgaaaatgataagtgaaaaaacccaaaatgacagtacagcattgcctatttgctttataccagtttgaagtaatctcaagaacagattgctgtgcaaatacatcaaacaaaatttgtgatttttgctgaaacaatcatacggttgacggatgcatttaagcaatgcctccagcttgttcacaccactggtcttggtaatgaaatgacagaatacaatattacctattttctgtaccaacctgaagaaatttcaagaacagattggtccagctcagtgcaaacacatcaaaccaaatttgtggcgtcaccagcaagacctcatgtttgatgaatgaattcatgcaaggccacctgcttgttcacagcagggaatccatcttttgctgattcgcatggtagtttcagtgtctttacaaaaccctgtaacagcatccaaaatgaaacagcaccagcgagagctctgtgccttgcagaacaacaaaatcatcagattcggcacggcctcgcagaatcggcttgcattggactaaccaaataaccatactggaaagacaaaaaagataaaaaaaaaagagagggtaaaaacgagtttaagctacgggatgcagctcactaacatccagaatttacagagttcgtctggaagagtgagacctaaagactgctaacccttctctactacacaaagtcaccatctgtctagtcactaggcaatgtcaggccaagtaggaaaaaaagagtggcaggattagagcacaagcaggatgttggcagctctaagcgcaccctgagcatcagtcagacgggctaggtcccttcccgagcaatccatcgtctgctggaggagctggagtgtcttgaagagtctcttgttgagttgcagctggagcggttgcgatatctggttgggtctgctgtgaagtgccctcctgggtatcaactgcagtagactgtgtagccccagctggagtgcctggtgctgtgcctccatcagctgctggtggttggtcacggcgcctcttgaaatacttcttgcagaatgagtccccatgctcagggtaggtcttcctcacaaaattctccatgcattttaaataggagaaatctgaccgagttccatctgaagacaccacaaacaagcaccgactatcctggaacacttggtgcttgtcaacctgtcaaattaaatgaggccattgcacaccataagccaaacgaatgctatatttcattatagcgtatcgggcaattgcacaacaggtcaacccaaaagtaacaagagaaccataccattatgtgatcgatttcaccagacacctttgattgtttctcagggtggtgttcaagaacattctctttgatgaatttttcgtcttccggagaaagttttatgctatcactgcaaaattttaagtcaacaataaagttaaaaagcttaagacagtacaaatcaattaaatgtcggacctagcatactttcatataaaagccaagcctcctctattcagaaacttaaaagcatataactgtaaatcatgaatcacacaaaattaacaaataatcatgaagtaacttacattgattcacggaaaatctttctgatgctcagcacagtgggttcaatttctcctagaatcttttcctcctcagctgttaggtcaaagtgtcgccttggtggccccctctcatcaggtctcctaggcagacccctgccatcaggtttccttgggggcctaccaggattgtttctttggcccctccaattgccacctctggcaccccatccatctgatttccagtccttattacgtgactcattggcttcagcagaattccagacatcatccccttgggaaactggagcagcattccatgcactatctgatggagatgcaggcacattgccccaggattccttgtctttgttagttgaagcatcaactccagcagacttccaaccatcccaagaatcagattgctttgcatctgaactttcattcccttgggaaactggagcagcattccacgcactatctgatggggatgcaggcacattaccccaggattccttgtctttaactgaatcatcaactccagcagacttccagccatcccaagaatcagattgctttgcatctaaacgttcattcccttgggaaactggagcagcattccacgcactaaatgatggagatgcaggcacattgcccaaggattccttgtctttgttaattgctttgtcaactccagcagacttccagccatcccaagaatcagattgctttgcatctgaacgttcattcccttgggaaactggagaagcattccacgcactaaatgatggagatgcaggcacattgcccaaggattccttgtctttgttaattgctttgtcaactccagcagacttccagccatcccaagaatcagattgctttgtatctgaacttccattcccttgggaaaccggagcagcactccatgcattatccgatggagatgcagtaacattgccccaggacttctctgtagaagcatgagcatctgcagccacagtctcccaagatttgttttgcacatcattattattttcagcttcatcattgcccctgccccatgatcccttttgcgcattatctttctcccaggaacctccatttgatcctcttcccttgttctctttccaggagttcccatcattctgagtgctagactgcttcttccagctggctcctccatctgttgcccttttagggccctggacagaccaagcatcatgttgagctggctcttcagatattttctccttctccttcgccttttcagtgccccagcctccccaatcagaggaactcttttccactgtcgcaggcacatcccaacacgaattcccttggtttgctggttttgtgactcccgtgtcagctcctgcagctgcatcattccaacctccccatttatcagaatcatttccagcactaccattctgttcccagcttgcatttgttgttgtgccattatcccacgagctgttattctgaacatcttgctcttccaaattatcatcgaagatcggttgaccaatggtcccatccaattcaggagataagcacacatctgcctcgttctcttctgcaaggtagtccacatcatcaaagaatgtgtatcttgccttttcctcgtcagtacgcaccaatgccaagtaatcatacaggccatcaccatactccttattgcttttcagctgaaaaaaatcaattacaacaataagcagagctactttttcactaaaacgctaattcatttgattggtcacaccgtgcaaagatctttaagcagattagccccaattaaatagagtgaagccccacttcttatataatcaataagctccagtgggcagaaaaaaccagcttacctgactttcattccacagaatctgaaaagatgatccagtaccacttgcagcatgcttgccccaagaacatgatgaaacaacacatcccaatgaatccgaatgacatttctctgcagccttctcaaagcatttcataggggtctacaaaataaaagggccaaatcaataaaatgtatgtgatgataaaaaacaaaccaattgatctcagagataagcttacaatcaatgtggactctgtgaaaggtacttgaacttttaaggaacggaaggtggccttgtaaccagcattgttaaatccattcaggtttccagtaaatgtcatgctatttgccacaagtaccagatgatctttgagaacatctttagcgaccatccttacagttgttgaaagccgctgcacaattcagcacatataaaataatctattgaaatgagatgcaagataaaaatttataaaatgcattggacaaatccataagcacaaacatgatgtacaaaagagttcatcgtagaaatcaaatacaactcaattgaaatggaccaaacttgcccattaaaaacaaaaccgaatgttccaccagtcaacattctctattaacattaaaatcttggtcagacatggaaaaaaaaatgcaattatcgcattcacgcgtaaaccatagatagttccccaacacacctagatcaacattgtcaaacagctatttccacggaaacacagtagtttgtgaagcagaggtagccatagagctatcatgaaatactaagttcatatatttataaattttccttagtaagttcttgtaaatgcaagtggtcaaataatccattaaaaagattggaaagatctgcagcgtgacctgcaaacagcagatttgaaatgaaatacctcccaaacttacaaacaaaaagggtaaggtgacaaacctgcacaacttgatcaaaagcacatgagatgccaagaagttctcgcacttgttgaataccataagggattgatctccgtatatcaatgaggttcagaaccggtatgcaggcatccattgttgttctccaggcatcaccaatatgtaaagcttcctcttcttcaacaataatttctactgctggctcaccctttgatgccttctgtgtgtttttaacccaagatgttgcatccgatccaacccaaacaattttagcctcttgaattcgaggatcacctgcagagcaacattctcaattcaaggaaattgttgagctaaaagtactacccttatttggttaacacatcaacacttttttttttgtgacaggacaggagaacattaattttataacaataatttaaccaatagaatcagttaactaccaaacattaacagagaatgtcttaatctgttacagctgtggagccagcaggcagcagctttagcactaaagggtaccaatttgttcattatagtcccatcctttgttagcaggttatcctttagttatgccaggccatgacatcctattgcctcaaacagagccacatctctctatacaatcagatgatctttcccttaaccagctactctaaatccatccctcagtcagtgcactccacctagtgccattcaaccacaagccatcattgtttgaacccctccaatgaatggtttaccccatcatgaactaggtttgcaacacaataacagttatggttctgaaaatagtggtaacttttttgggggaaaaaaagaaaagtattatgaaagacatgagcgtgaaggaagataattgttttttaagggctaaaaatggatcaatcataattctttggctttttggaccccccccccccaccccttaaaaaacatggcaagatgtgaataaaggattttcaactgaacctaaataataaattgtattgaaaatgaaattccaacagaagcatattatgtacaacttacagtaccttttatgattgtattcaaaagcactccacatagagaatcagctaacacactgactgctctctccactgattcagatactatcatgttatcagaaacaaagaattgcaaacacggaagcttaggtagctttccatcaaccagcttctgtgtgaataaacaatcgctgccaagagtaagggtgaaaacttgagtacgattaaataatataatatcgtctcacagtaaacagataataattaatgctaaaaatgattaactgaaaatgaacttaagtagaatattgccaggaattgtgatttgaaataaacaatgcatcaatattctctgcctagacgatggctccattgctatgccaagctaccaatactttgctataaacaacatgaaaaagaaaatcaaaactgaacaatcttggaactaggaagcaaataaagatccccttacctctttcttatggctcatttctactacttcaatggagatgaaacttgcaagccaggtacagcatatggttgtagttgaggttaactaacttatcatttgatacagcgagcgacaatcacatatcataagtaggatttcacatcatcatgatgttgaaatattagatattgaacatctgattaaagagcaatgcagcacttgaataaccctagcaatctacaagatgacaaccctcttctaccaaaactataaaaccgccaacaaccatagcaactaatggcaggacacaaccacataaacaaaacagcagtgcgtgcaatttattcttcaaacgtgagatctcaagcaatatagtagagaatagatagttaccaagtagagaatgtaatatttttaaacaggttactgagatgtcctttcttcttcccatatttcccagaaacttcttggcatttctgaagaatatcttcagtgctaatgttgatcctttctaaatgtgcctgaaagaaagatgtacatatattatcagggcataataaaaacaactgtttgcatgcaagtattcaccaacataagaatatatcataataccctgtcaagatgaatatggccaacaagtgctggggctgcttctgaagttccatctaaacctatttgcttctggtacctgacaacgtgaatgttatatttaaggtgttctgctcaaatgataatgaatactaaaagccaacaatatgcgacaaggagacttttatctcaatttccatttttgagaatgatcaaaacttgcatttatctgggtactgtcgtgaccaatttctaagttgttttatggcagttccagttgcataatgatggacaatttcaagagtatataaatgattgaagtttaacatcaatgaaccaagtccatgactagttagtggacaatgaacactgatgtgcagatccatggaaaagagataccgggttctcagcattaaacagataaaatatgaatctattagggatggcaatggggacccggacatgataaccggcggggaataactctattatgggctgtaaatgggaggaaatcaccctccatggggctgttttaggccaaattgttcacccatcgggtgggctgggagcggggacgttctgcaggcccccggcccccgaatccccatggggccccaagtcaatcaggaaggtgcaaatccctttaagaccacagcccaaaaagtaaaaaaaaaaaagcatttagaaggcccaaatcagaggtgcatatataaagtactgaaaccttagcacagtccacatccactcttccttccactcctcccctccactctctcagatccaatcggcagggcaaccagaaggagcgagagcgactgcacgaagccacctgggcaaccagaagggcaacctctaggctgcgccactgtgaagcttcaaggacacaccacgtcactgtcgcgactaacgcgccgctgccactgccaatctatgacctcatactttgacgctgttggtgtttaagtatggatagttggatatgatctgtttgatgtttggttgttcaggcatttgtgtttggctaactagttttgttggttcgttcctggctttgttgctgttgtgctgtcatgttgctggcttgtagcttgctactctcttgttcctgttaccgagtgtggggacccaccgggtgacccatacctggtgcagggatggggacagggggaaacttgactgacccgtgtgcggggatggggatggggacgggcaatatcttgcattgcgggggtggtacggggtgctgaaacccagcgggtgcagcccagtttccatccctaaatatgataagacctaacccagtcaaacacactgtttgtgcaaacagataagttaacactaagttactttctagatccacataattttcagttcattggacagatattgaacatttgccaactatctacattctatatccgcaaaactttcacatttcaaaaatggaaagtattctgaaggaccaaaaaggaaaaggaaacttgagttttagactttggtataagaaatccagggaactacaataaaacaaccacaaaagaaataaagtccttcattgatttcactaaaagcaaagcaagcgaatataactacataccccagtaattgacagcattaatttatataccaatataattgacagcattaattatggatacttactcaatgcagatgtcagtagcacaatcttctaacgtaattctccttaggcagccctgaactgcaatagcagccttttccttgcaaaacttcttggcacaagagcaatcattcagaaataggataacttttcggtctttcatatcgtttttgtagcgacttgttgtctgaagtatttcctgttaggttaaaggaatataccaaacttatcatgcatgcatacaatattaccttttaccaatgcataaaataatttaatgttattaccttcatccgctcccatgaagtattgttactctgagatgcatccaagacagccttgtatgcagggttggagatagcagtcgcagccaagacaccaactggttcgccaggacctattgcactagggaagtccaaggcatcatcctccgtgtagttaagttgtatgatagacttgctgcagacatttcttactgtcccatcatagcatatgacgacatcccgcagtaacgccattagattcttaaatagtgttccaggctccgtcaaccccctagaggagcgaacaatagcttctcttgtcgaaatagcatgcaccagctcctcatacggattaaggccatgaaaatatgaactccgtacaagaccatatgcctctggagaatgttcttctctgacagctgggtgcttgttcacaaaagtgtagtagcaatcctccaccagacgacgtgagtagaacttcccctcacggtaaagttgtaaacccacaaaaccaagctgctggacaactttagacactgaagagtcactctttggatcaatcagaagtccaagatgagagcgtttcacaacaaaatctgaaatttgctgtttgatgtccttcaaattattatcaacacgcatttcaacaacctgattttctgcaaatcttgattgttcaaggataagagactgtttttcaatgttcttctgtgcttcttccaatagaaccttgggaacattgaagtcctggaggcttacactaaagccatccaaaagaatcaattccatcaataatggctgcagcacattcaaaaattgtagtgcttctcctggacccttaacagaaagagtggaatacactaaatctgagaatgatgtctgaacagattctttgtcaagatccagttttataatagtgctgtccctgactacgtgtttgtccccttgagaagttaaggcttttggcagagcaccttgcactatttgcgagattgtccagtacggctttgacttgatcacagcaggatctggaagagaacatgtaacaagcattgccagctggttagctgcttctttgctcaacattgttctggaagacatatgcttcagagcaagcaaactgtcactaactagctggagattgaccttgccactgtgcgaactggtaagctgcttctccacactgaaaagctccagtgcttcagcttttgcagcaagggactgtggataatagatgtgcacacaatcaccgtcaaagtccgctgcaaaaggtgcgcatatgagcggattgatcttgaccgtatggtcttcatggacatacacgcgaaatgcctggagggaatgcttgtgggtactgggtggacggttaaggaaaacaacatccccatcaacaattctcctactgatagtctgtccgactttcagggtagtgtgacctttggatccaacggtgatggcataggttgcctggccatctctgtaggtcaaacacaatcccttatccacaatctcttgcaacctgttaaggttgatgtctgttacctgctcttcgaaagtgattctttttgccacttcagaaggcagtccaatcacatctactccaatatatggatctccagtaagtacactgcgtgatgaaaaccctgaccctttgctgataaataatgttctcatcttctccagccattgttttgttgataacgcagaaggatcagtactgattgcaaatctcttggtgttgtcttgaggaccctgcaagacaacattaccgtgggacaaaagaaacaagactaaataagtgattgcacacaactactgggagagaacggttgtaaaacataaacctatggaagaaagctttaacatgaactaatagttgatgaatttcatgaaccttttcaggtccaactactatagaaatgttgtagtttcgggtttaatagctataagggagttcgataatatagttaatgtagggaaatgagcagttttgcttagtgtgtctatgatcatgacggacgtcctatgcaatatgaaattatgaattcactgacaatgcatgcatggtttgcatggctgttttctctaataaagggtgcacatagacgcacaatagcagaccgttcatcctcaatgataaccatccacagtgtatactcatgcacaggatcaacccgacacaagatcaacccaacccatatggatatgcttggtcatttgttgctatcttctgagagatttatgaatcaaaatcccttgtatgcatgtgctcagtcattataattatattaatatgaagtcaaatgtaaattcatatttttagtttggttactataaggagtattgaaattgttgtaaaaatgagcttaagtcgacagcctgtgcaaatgcagttgacaactagtcgatcctaattcatggcttggtgacaattacgattacaaaacaagtgaccaatttgtgtgtgagcagatgagctactctctggagcaattctctagctgagacaggactctcctgaacatgctctcatgtaaatatggtaaataaactatcacattaagatcatgcaacatacccttgtagtgccccttagatgtatgtactgggcaatagagagctgtagatcacatgattcaacttcatgtgattcaaagtttggggatccagctcttgacttttttatctgctctattttctgaagcaccttcttcagcagagatattgatatgtcctgatatgagaagcaagtataataagccatgacatagaattgaaccagtcaggaaaattatgaagaacaaacgtgaggaagaactcacataggacatgatgctctgcccatctgtaaattctggaatgtataaacaatttggtggcacggggaggtatttcatcacatatccagattgagcaatgtaaccacgagcagctagtttcctcttcgtttcttcaggaattttcttcaatatattgagagcctagcaaacgatacaggaatgacagacgatcatgtaggttgttggatatttaggagcttacagaagtcataaaaataaagtaaatgagattaacctcttccgggagcaaggtcctgcagtgggaggttccaccatggtgaaatccatacttgtcaaggaagttccatgagccttctgtcatgaatttcctaggaggcattttcaactctaaacgaaatgcaccatctgctgttttgatttctttcaaagataatgccggaagatcctaaagaagtaaatggcgatgaacatcagttgccactcatccggattgtaaatgtttatagtgtcaaggctagcatctaataaaaacaactaaagctgtataccaaaagccatacgctaaaaaactaataaaaacatgatatagtaatgcttatgtcatgattgttggccacatcttacaagttccaataacactccatcatacagcataactttgatcctgtgtactgttttcaacgacgacatgttactgaacaaacataaaactgaatacagtgctagtctgtcactcattctctgtgtagacaaaaaaactttgcaatcaatggttttattgcaaaagaatgcaacataaaacttattccgtaacttaatatataagtgaaagcatatgtatggataggattactgagtgaatactgcaacagctatgtcagtaacattggctatgttttgcccaagcagattttgatcaatttaaaaccaactaagctgtaacatccggactatgtatgagtggattaaacttaaaacactggtatacttggttcttcgagaggcatatgttccatattcctactacttatacatgtcaaacaatgaaatattatgtctgtctacttcaaggcagaagggatatacaaaattgttggggttggaaagtacccgacaatagtagcatgacaatgctgatgtgttatcctttccctctgtctgtttgacctgatacatggtaagatcacattaattataagccaaagtaagacaattggatttagaaaattaagacttagctgctttgacctgtatgtacctttcctttcttgacgcggaggcatttcaaacataccacatttaatatctgcctcagttccgttacatggcaagggtgatatataggcacaggcagctcaatgtacccgaaatgccctaaataagcagataattttggttttaaagaagagaaaagtggattgtcagttgctacagaacaatatcttgggcatgaaaaactaatgagaagtcatcatgtgagaaccttcgcattttccattttctgaggcaccacaggactcgcattttcctgtctccaaaggtaacccaaggaagggatttccgagctgactaggatgagtgacaggacagtcatttatagaataagtacgctgcaggacagaaaggtgtgtatcagtcatgttggaaataaaaaacatagtattacagtaggaaatataaatgggaactgtgcaggatatatccttgccatattcatgagaaacaaaaaatacaaaaaaaaagaaggctaaattcatatgaatcaagtagaagaatgcaacatcaagtatttaaatccacaaaatgtaaaacagctccgttagttagcgaaaaagcccatgtatcagcacttccagatgcaaaagaaaatgtcagatttcagtattaactaacaaacaacattcatctttacattgcaaaagtaaaggtcaaaaagaaaagctctcatagcaacactcatcttgataaaattaatcttacaaattcaaattttgcattgcgattgaatagcacagatcatgcatcataggtaaatctaattgaatgatatcaaatataaaacttgacctgacgggggagggagggtaagaccttctcacgcatgtcaagaaaaccccctaaccccccttacacagcggcacaggcaggtcaagaaaacccccgaacccttgccccacccttacacagcagcaccgtaacccgtgaaaataggctggtccttagacctatgctttggcgtgggacaaacgaggggattttttttcaaccccagcctgaaattcgctcccacaaggagtcgaacccaggacctgaggagtgctactagagccacctaaccaactcagctagaggtccattcgcaaatgatatcaaatataaatgatagagaaaaggagggtttctagatctcatcatcaagagtagttacatcaatcatatgctcccttatcagacggtactgtctctaatggatcacaatgaccaagttgtcgcttctgcatgcatctctttctgcaagcattgctggtaaaaagcatcagagaaggagaacttacaatctcatcctcagtggataggctaagcttgatgctcttgatggcaccttcagcaaccggaattgctgactggtcctcctccatctatctgaaatagacaaagggacatggctgtgtccgtaaaaagaattgaaaagaaagaaccggtaataccaacaagctagaacccaccattagctccaattaaacaacaagaaatagcagaaacaaacagaaaacagcaacctcaaattcgcaaacgtaggataaaaaccgctgtaattatttgttggcttctcggaaaataccactccaaatcaaacttgcttttgattttaatcatttgtttccttttcctaatgggtgcactaacaaatatattcccttagagagtgtgcccttgtctccaagcaagttaattagggcaaagtggctaagctaatattaggttactcctaccgctgaagctgcatttccttctgtttcatcttagctctagcatcctactacgacccaccaaaagtacacccaacaacaggggaagatccaaaagtacaaacaaactgttacttgtatcaaggttaaggctctgaaattaagagaaagagcttcttccagatctagaagagaagctagggttaacgaacgaacgcgagcaaattccacacaaaagcactccaggtggtagagtgagagatgaatcatcagaaagaggatgcggatgctcaccaggatcccctcccctcccctaactaaaaaaacatttcgcacaatcatcaggattcgtttagattcccagcacaccacaaacttccccccaaacccacacggattactccggtgaacatttatcatacatgagatagaaccccttagttgggaaacaaaaaggcatatcaaagtgcaccaaaattgaataacccacgcctctccgcacgacccaaatcttcccttccctcggggaaacccaaaccccccacaacaagcgacgatgaacagacaaacaaccaaccacatcccctttccccccatttctgcgagtaacccagcgccccccacattgcggagacgggatcagagccctcctccccctcacctgaacacccgcgcgcgcgcgcgcgcctgcctgcctcctcccaccctcgccctaaaaccctagccaccgcgcggggggtgggggcggagagggttttagcctgcagccaagccctcgcctcggagaagccgagaagggaacccacacgagcgcgagtgcgagtgcgagagcgaggcgacgatggtggtggtgggaggtcaggtctcaggtgcagttcagtgtgcaggtcaggctaggtcacccccgcgcgccggcggctgttcgacgccacgtcactgacatgtgggccataggctggtcgtggcgtaggtgggacccacctcgcagtgagtgtgggggtcaccgggggtcacgtgttgggagctgggaggagagagatggggggattgaccggaaggcattgaatgggatgacgtgtagcaccaactgttgggtgaagccagctgatttttggccattctttgatttgggtggtttttggcagtaaccaatgtcataaatgggcaaattatcaagcgccaaaaatgaacacaggcctttacacaatgccaaaagaaaaggtgacacgcaaaaggagtagcaagcagtatatcatttttgcatggaaaaaatacagagagctagaatgaacgaacgaactcaccaacgtggctgatagaaatacgatgtcgttgatggctagaccaagcaggatgatgttgagtagtcatgagaagcatgtgaccatagtaaatagaagggactcaaaaactgagccaattcgatgaaatagaagtcaaccaatgtatctgcatcaatactcaactagcattaccaagataaatttggacgctaaaaaatgttgagacgagcttgcccgaacaagctttattgtgcactaggctatgctttctcgtgatctctcacttatcaacaatacacaccatgagggcttgacgatgattatcattgaccatgaggatgagttgtgtcatcacctcttcgtcgtaactcaaaaagacgataagccaaccacctctttgtccaagattagggcatctctagtgttgcattgattagttcagtccatgcaaacgaacaaaacttatgtttgatctctgcagcgtataaatcgttttgtgggacccagtgggactcacacacgtgcacagtctcggccttacccacgtcttcctctttctcacgtagcccgatgaaaattgtctgtattcacttgtgtttgacacctatctaaaagacgattttctcgctgacatgcacgattcggctctcgtagtgtgctctgctcgatatttcaatgtaaggtttgatttaatcacatgatgttggagtaaatgggctaggcccaatttattcccaataaattccattggctcacaaataatgttatagaattaataccaccttgaaaatttaagtggagatatctcaacttaaatagagagctattagagagcacatgttgaccggttgaggtgatggtgggattgccatatgcgcacgcgtcacgccgagccgggcacaggtgaggcatcacctgcctgcacgggtgctcgggacgagcaggcctccgaaactccatccacttgtgtatctgcacgagtaggcaggtgatcaagttttgggggagcatcctccggcacgactactttgcatcaactacgtcttctgctacactgcatccactatatcctctgctacgtctacttcctcttcgtcgcgtgcgtcgactacatcctctgctacgtctacttcctcttcatcgcgtcgactacatcctctgctacgtctacttcctcttcgtcgcgatgtcttccactagcaccagcgttgctggagacgaagagaatgcccgcgcaccaggaggaggagggaacggtggtacaggagagagcatcaacggaggcaatactaatgcctgatcatccagtggatcattctatgggtatatatctactctgatattggtgttaaacatgttgctaaatgtttttatacctgttaacatattcatattcatgtttatcactatgctaggatcgctgtatcttgttttttttggattaaagtatgccgatttattaccaaatttccaacaaatgatgtgcaaaattatgcacaaagatgaaaatgtcacctccattatccaccaaaactcaaatgcatcatcgccactacctttacgcctcttagctaggcgacaagccaatcacccctctatccaagctcaggaggatgatgagcaagaagaagatgcgaagctatatagagaagtgagaatgtcaccagaaggctccaatgtgtcatcacctctacctccacgcctcttatctagacaacgaaggagagcacggacaaaggtgaaaagtagatgggagcgtctcaccattgctacacaacaaacaaggccataagaaaggtaggtggtaagggagagcgctgccaccacttggtttgaccaagggaacctagaaccatcgaagggttctcttatataccaacgattggtttggtttgggcttctcggataacgactctttaacgacccaaaaggccagctagtaatttttgtcccttttttaaaaaagaatttgtggtaaaagcccaaatactccaacaaactatatgcatactacgttttgtgcctcgtgcaactgattcatggagacaatgataggttgaacccacatagcagtggcaggtaggtgggtaggtcgttaatgatgttgttttcactctcatcatctcatggtaggaggaaagtacgattgtccgaatttttattaacagcttgaggttttgatacagttggaatatcttgcgatatttatgacttattttccatatcatctcttagtgcaagaacatagaaatatagtgttacgcttccaagcgacccaaacatatataaaccacttgtctactcactcctatgcacaactcaagcacgagctcggaacatgcatgaaccctagctgaactctcaagggaggccatcttgccttcccactagaggagtaccttgctccaacatgactaaagattgaatgagtttatgactatacatctcatagtcataggttgggaccgagggaacgtggactaaaaagccaacgtttatgaggtgaatttcacttgtgtattatgcataaagtagaaaatcagaaagaaaaatcacgagtgagagaaaggggtggcatcacctaatgtaatcccttcatttttaaatacacgacgttgttaacttttagacattacatttgaccatttatcctattaaaaatttagtgcaaataaaaatttaagtcatgcttaaattactctaaaaaatatgtcacaacaaaacaaatgatacatatattgttttagtaggatgaatgattaggcatcatgtccaaaagtcaacattatcatatccaacagtatgttaacgatttttcatgcaaacaaatgtgaaatgtcactgttgtatgcaacatatagttatgcagtattgagcccgcaatagttctattgaaatttccaaacacttctcgcaacatatccaatcaacaatctcaacaaaaaattcacatttttaaacacctggtccattgtcactcatttgcctcatcaaggcccttcaaatatcatgtagctattgtcattggcctttgatacaccagtctcagctttctacatgccattaccatttctttccagaaggctgctacactccattaccatttctcaggcacaattctcacttgacacatttccagaaaaggagtttcagataaggatgcaaatgggccagtggccagccacggatcgacccgcttaaatgatttataagtgggtttacgggtcagcccacttgcatttcggatcgtcgctaaagtgtcctatgaaacaaaccaactattggggagcgagcccattgtcatagtcactgcccctccttgttccattctgcaggttcctctcaaactccctcaggtaatcaagaagcaaaacgatcacgaacaggatgaatccaccggcagagttgctgccgcctccacctccacctcctcctcctccaccgaaccggaatggcgggaagccggtgcctccatcgtcaagctttggactcctcactttctctgaaagcataaggtcatcgaattaagaagtgagaatcccctaaaaaaatgtaagaagtgagaaactgtgagcaaatgcagtgaaaacatagctgttatgtacaatgagattcagttcttggaggaggaaaggactgttatgtacaacgagattcagttcttggaggaagaaaggacgaacatcatggattttgcatttttgctgatgctttgcattacctttaactgaccctgatggcggtgaggtaggtccagagaaagatttgcgtcgtgcagtctgtgtctggtttgcgcaacatgttattctctgcagaaaaaaaaaagcaaattcagaaacagttagtgttaggtggtttcagaccttttgctggttagaacttcgtgtctgcacttctaaatttagaagcatcatgctgcacagcaacttaacattgaaagttattacaaaccatagctacttaaactcatgctgttgctttcttaaaaacagcacgatagtcgcctaataaaacttaaactcatgctttgtgaagtgatgagtataatcagaattcaagctagcaccagattgaacatgaaaagattaaataattagcagtttggaatttgttttcgcttcacctatcttaggtctcaattctttttctctagctaaagcctgaagctctgaaagtctagttaaaattccctatttttgcaggagtgatttactttttgagactaatgattactccaatatgaatagttgaagaatatatgttccgtgaaatggaccaaagtgtcacacataaataacatttttttaatattaaaagtacagctgggagaaagcactctttcacaacatcacaattttatatgagatatacatctcttgtgttacaaaaatccaatacttttaaatctgtgattttttttagaatatgcaaggagcgcttctttatatataaatctgtgaaatgtccgacctattctaatttcatgaactagttcaagttcaaaactttggatttgcactgaagcctgaagacatgaactttctcagctatcagatttgctgatgcagtcatacctgataaatgtatttctgagaattagtatattataaccaataaattgatctatgaagcttttgaccgtgtaaaactaaaacacaagtatgacgagcaggcatgtcatagcaaaaccaagaaatattctacttaaccacagaacagacaggcaggcacgtcctcaccatggatgcttcgcatgaagaaactgctctggcagaaacgctgagtttagtcttgagagatcgtgaagacgagatagattgtccttcctggctttgtcctacattgaataacaataagtttatgctcatactaaagcatcatcacctaatattaaattacattctgaaatagtactcatctctctttttccttacagcactttatgcgattgacaatatatcagtagcaattcttcttttttttccctttaaaaattcactcttttttagaaaaaaaaaagttcttgcgagacgagtgcagacagcatttcttgggtaagacaaattaagggagaccgattatattaccaacctccacgatttctcccaatcccctggtacacagcgggggtcaacagaagaagcgaacctggcgatgacattgtggcaagtggaggcatgatatgcagcagctgtgtagacaaaaaccactcctcaaaaaccactcctttctttctgagctgagctgtagatacaaccaggcactagcctgagcaagaaaactgcagaaagaaatgggagaagttcagaacgagattgcaggtgcagtacagaagaattggtgcaagaaaatcatgttgcaggagaggaggagattacctggattttttagcttgcagaagtgtgtaatttgcaaatccgcaggagagaagaagatgagagaagagatagatttgggtgggaaattggggttttggatgagagaagagtgcagagtggcagtgacatgcggctgggacgtttggcaacgaatgttatccgtatagactctggggtcaggtcgcggagtcgtcgctgatccgcatcgtccaaaataaatccaagggtcaagaacaaagcagagggccagcgaagcgaagagcaagatagctcggcaagacatctaagatgctacttcgatgatcctcctgagaacgatgtcgatgatcctcttttgaattacagtaaagtgtatgggttgtacttacaacttgtagagatgtgtcatttatatttctaaactcttaaaatacatatccaaatcgcagaacttgtcatagtgtgtcatctaggtctcaaatcaccacagccccttcaaaatcctacgtggtgctgatgtggcatgccacacgaacatttaaaaattttcactttctttttttttctctttttcttctccttcttttatttttttcctttcttctcctttcttcgtgacccgagcaaaagaaagggaaaaaagaagaatgagaagaaaacaaaaaaaaaagaaaagaagaaaaaaaagaaaaggacacgtcacgtccacgtggcatgccacatcagcgtcacgcaggatactagaggggctatgtcaatttgggacctagatgatataatttgacaagttttagaacctgaatctgcattttaagagtttgaagacctagatgatacaaccctataagtttaaaaaccgccaacgcaccttactctgagaattatgtgctacgcgtggctcgtgcacttccctgttagcatgagccaattattctagtacagataatttatactcattcatgttgtttttttaatatattacacaactataagttcgaccattgttcttattcaaaatattagtgtagatattaaaaacataaaatatagtatttaaagtacacaattaaattacaacaacataaaaaataattacataatttttcaaataaaataacttatgtccaaaagtcaaacgaacaaagagagtattttttttacataaaattaatgtaataaattcatttcaaaatgttttttaaactcatcgtaaaattaaagctctcaaaagttagtcataaatatacacaatagtgtaatgtttaggacttaaatccggtgaacaagttataccaaaagaaaattaatcagctgagcgctcactgacttcagcttataattatgcttttgattacatgaacgaagcttttttttttatggagagagtatatcaatttcatttttattttcaaatacactaatacaacctatatatttttcaaatatataaatttctctttttaaaatctgctctgtccatttcgtattataagtcgctttgattttttttactattcgaacttctttagattcaactaagtttatagaaaaaactacccaatatctacaacatcaaattaatttcattgaacgtaatattgaatatattttgataataagtttgttttgcgttgaaaaatttcattattttcttataagtttgactaaacctgaagacttaaacttgtttttggagaaaaaaaatcaaaatgagttataatataaaaaataaaactgtttattacaacaaaaatagaaactaagggtgtgtttatttcacgacaaaattaaaaatttggttgaaattgcaatgatgtgaaggaaaagttagaagtttatgtgtgtaggaagttttgatgtgatggaaaagttggaagtttgaaaaaaaagtttggaactaagaccctatttacatgggactaaaacttttaagtccctatcacatcagatgtttggacgctaattataaatattaaatgtagactattaataaacccatccataatcttggaataattcacgagacgaatctatttagcctaattaatccataattagcctatatgatgctacagtaaatattctctaattatggattaattaggcttgaaaaatttgtctcgtaaattagcttttatttatgtaattagttttgtaagtagtttatactatttaacactctaaattagtgtctaaaaatagataacaaagttaagtcctgatccaaacaccggcctaatgatgaaagtaggtgtacagttacgtagggtaggaacatcatatttgctactgctattgctacccctgtggaacggccgccgtcgtcaccgctccacccacagtcgtcacctcacttcaacgctcgtcgtcctcctccactcctccacctccaacctcctcgcacgccctccctccctccataaacataaaagccctcgcgcacccacacgcccttgtcgtttccattccacccttccaattcaacgcccctacaatggtggcgcccatcgacccacctcgaattcgtagcgcgaatcctcgtctcccaatgagcatttaatcggtcccgttccgttcgccgaggctgcagtgagctgaatcttttgcattcttgccttcttggcttcttgctgctggagaagaaggagaagagcgcgcgctccccatgccgtgcgcgcgcgccgaggacgcgctgccctccgccgccatcgccgccctcgagatgccatcctccgccgccgccgccgcagcagcgtgagtgtgattgttcttgaatctttctttctttccttttttttttgttttgttctcgtgttgatttggtttccatcttgttgctccctctgaatcttgctgaatgctgggagtgatggtttcagaggcggtctgatccagaaggtgggcggcggccggagatcgggcgggtcggggcgggcgttgcatcggtcggcgcatctgtcggcggaggacgacggccacgcgccgccgccggcgagctgcagcaaggttcggttcctgtgggcttctggttgactcgtttctatctccacagcccctgcccagcatccagacatcccagaaattcacattctttgttcggattcggggacaccacggtttgggaacactcggattactggcacagaaaagcgagatttcaacggcaaatgcccccgcaaaagcggtgtccttttgcgaaatgccgtggtgcgcagggcgctgtcggcttcggctggccgtgcctgcaaaaattgtttttcattgggtcccccccaaaccaaggatgaactgtcccctaccccatttgtctccactttccattaatcgccgcagactgtgtggtcaaccaacaatcttgttgtttattgcttcctgggtttatttctgccaatcgaagtaatgtcacagcaatcgtcgttttcattgttgtttttgtaggatgataagatcggtggtggtgggaagagagaagggagccagaggagcaggatgaggaagtacaggtcgcagctcgagcaggaagtaagaacttgctgattctctttattttgtggccttcttctacagactacaggcagatgatgttagtgtgtaaatgtgatgttctttatactatcgaaaattgtgcaggtcaagaaattacagaggcagctcgaagaagagattgatttgcatgttgcgctggcagacgctgttatgcaaaatgctggacctgtactgaactcctctgtgaagattccatacaaggtgaagagctactagctagttttcttgtctttatggaatgccatttctgagccaattcagtaatttttgttttgaccttttcattctccaggcacaagaattactaactaacattgcctccttggaaagtgccgtatcgaagcttgaaaaggacttaaatgaactatattaccagctttgtcatgaaaggaatgaaaggttacttgccgaaagtaaaccagggtgcttgccatctacatccccagatcactcattgtcaacttgcacgtgcacatgggaagaagtaagtttttttttttttttaagtaaatatatctgtcttctttctgatgttggagttattgataccttcttgttatctttcttagcacatatcatcattgagagatttaaagtttggaggatctgagtcaatgaggtcaacacaacaagatttatactctgaacttgaatatgaacaagatgttggagaagatcctgaggagagacaaatggtttctctaaatagactatttgaaaaacaccgggatgtttctttaaatagacttctggaaaaacaccgggatgaagaggtccttctcatgcctatttgtatagttttggaagatagttaattgtgctagacatattcgtgcaaggtttgatttatctctctgcagatgcaagaatcttgctctactgataaagaaggcgaagaagatgagaagattgatactctatcatttgaacaatccatactaaagataactagcatgaaattagggaatctttggaacaatcctaaccagctctcagaggagatggttcgttgcatgagaaacattttcctccgtctatctgaatcctcgaagatgttaccaaaggaatcttctgattgttcatcttcctcagcagaacgtctttctggttctacactggcatccttctcagattcatccatcattccctcaatgctacgaagtccttcagttgactcgaatcgcaatgatgagatgacaactgaagccagcaactttgatccatataaagttaatgggaaggaaagccgaagagatattggaaattatcattcagcagctgaagtatcttggatgtctgttggaaaggagcaacttgaatatgcatctgaagctctaaaaaaattcaggtttgatgctgcaacctaggctaaaactgcctgtcctaatgtcaaacatactgcatgttatgaggttcatatgaagcatgtttttttttgaaacactcgttcatatgtatgatactatcagcatactatgcacatttctaatctcattttactgttgatgcctaagtgaatttacaaacaattgaactgttatgaggtttgtaccgagggaagaatgagatgcttcttgtaatcttttattttcaggaaacacaaaccgtattatattttatattttggaaccccacaacttgttgtcatttttagccctgaaaggaatccctggcagtgtgtaatttatccatatttgaatgtgttaacgagcactcttttccatgccactttgacttatctttgatgtatgataaaactttcaaccccaatgtcttgctgatgagcaaacaaatgttaacacatactcactacatctcataataaatgttttctttgcgacgctttccaagttttttggtctattttctgtcaattacggtgttcctcattgaagaccatctttaattcttactaatacttatgttgaatgtaagtgtaacaaataaccatgcctttgtatttacagatttcttgtggaacagctatcaaaggttaaccctaatagtatgaactgtgatgagcggctagccttttggattaatttgtacaatgcactgattatgcatgtaagtatgttaccaaagagactggctttgcaaacaagtcctgcactgatgatttatgcatatttctgttcctcatatttcattttgcttttactacgtatttctttctcactagactaatactatatactaaattttctgtactggtttctatcaggcatatctagcatatggagttccacgaaatgatatcaagcttttttccctaatgcaaaaggtttgagcaggatctcttctctgaacaaaaaatgtataacactttcttcaatatggatttcaattaacacgtgctagcgatgcaggcctgttacacagttggtggtcagtctttcagtgctgctgaaatagaatttgtgattctaaagatgaagactccagtgcatcggccccaacttgtatagctttttctataacctatttattttccatttgcttataaatcataacgcctctcattggtgtccctacctttctatagtccttgatgctagctcttaacaagttcaaaattactgaggagcacaagaaatactcgattgatgggacagaaccccttgtgttgtttggactcagctgcggaatgttctcttcacccgccgtaagtatatgagttttatcattgttttcatgtaaatatgtgtgtattgtactatttgttcagcaaatattgcaatcgccaagtgcatgtttctgcagcaaccattgcgctaccaaacaatattgcttgcttcaaatccttgttcagatgctatagtaacatgttctttcaatgacgtttgaacatccacactgtcgtaactattaacatatcaagctgttattttccttttcctctttttatttttttaacaatcttgtgatgatctgccgtcatacaggtgaggatcttctctgcagcaaatgtccgtcaggagcttcaggaatctttgagagactatgtccaagcgtctgttggtataagcgaccgagggaaactgctaatcccaaagttactgcagagctatgccaaggggaatgtcgaagattctttgctcgctgactggatctgccatcaccttacacctgatcaagttgcagtcatccgagattcttcttcacagcggaagcagcggcttcttggagcacgcagttttactgttgttgcattcgactcaaaattccgctatctgttcttgcctgacagcagtggctcccagaagccagaacccaaacggacttcgtgagctgtgttcagaaaacacatgctatgagcgagtatgtttggtcctagaaccatttcttgcatactggacaatggagtagctagttgtatatgatgtaaatttttggaggaagagtatatgatgcaacaaagatgagaagctggagggtgatacaaagagctccagtaaggatacaggatagttcatatgtatgatcagattatctcagctgaattggcgatgaaggttcatctggatctcattttgttctgttactgtctttccataatgaagataaccttttgtaatttttgttttcgacatacctttttttgggggtatagttcttgatcttggtcaattgatttgtaagttgtgctctaaataatgtatagtgcttttacctctttataataatgtgagttactttgtcactgtctggctgttactgctggaataagtaaccgttctatgagatgcaacctttgtcagatagataaagtttatgccttttttattcgaaatgcttggaatttacaaggaaaagaaatggaatcgttttgaatacaaacaatgttggcaataatcactttttttttttgggagcaaaaaccataacccttattatcatcatacattggagattttgccccctttttgtaaggtaatagctcaaactgctcgtcttagggctagtttgtgtatgcagtgctatattgttacaatgatatttaagaacttgttttttttttttcaaaacctatccttctgaactccattataacttctgcaaagataaaaaaaccaaaaatattaaactaaaatcttgaaatattaaacgttatattttatcaaaggtagccttcaaaatcaacaaaatttatgttatccctttcaagcaactcacctcaattacatgtggggccaaacccacttatttttccagcttgtctttttttagaaaaaaacatttcaaaaaatcctttagacggggcttttaactatttgccactcttacggatgttgcttaacgatttgccactagggcccacatgtcatagacacatgagggctcgcatgtcattgacagggtgtggcgaatcgttaattgccatgtcacaagagtgcaaatagttaaattacattgggccaataagtgggccgggctgcccaagaggcttgggccatctcctctctctcctctcctccttcacgccgcgagatgaatcccccggcgactccactccagcgccggcgaatgccgccgcccgccggcagcggcggcggcggtggcagagccgtttgattcccccagaagtttgtgcgggggaggcggcatccagctctccactcccagggtcagttgattcatccgcgctttttttttccttctgctcgttgctcttcacaccacagtgatctgctgagccgggaggggtaggagtagtagatcggctgttgctcgggacccgtggagtgggatggattgcgttgagctcatgccaaattgagacatgaacatccttgtgattttgcttttttcagaaacatttttactagtctcaggttccttatatatttttggggtaattttggtgcccatatcagttcacgtggtattattagttttccttgccacttccatcgtaataatcggatcagtaatatgattcacatatttggttatattgtaatcatgtattggtctgtcacttattatgttcctggcattctgcctctttaatcatggtctcctgataatgttgtgaatctgccttttttttttttgagtaaatttcattaaaccccacgtattatgatctaagttgcacaaaatcacaggtattttggtaagtggcacataaccctaaatattatggttataaagttttacaaaaccacatcgttaacattttgacatagtcctatatcaaaataaagaaagcgaatctaacatttttatgttggataaaatgcttataaatttgagatatgattgtagaactcaaaagtgtgtgctagattaaagtcaaaataattattaatgtggttttatgaaacgtttagactgccatgtgtcaaagttcttgtggttttgtgaaacttggaccattatagatgaggttttacaaaaattactccttttttaaaatcaaaatttaatcacagaataatttgctgaacgaaaaaataggtttggatacaaaacagtaaaaaaatggtaatctatggaggactgtgcaaaaaggaagtacacaaatattaattcttctgctactatgagcttctctgtgcacttcaaaagtttaagtgcatgatcatcatgtgctatcatattctgatttaattgagttctgttgtttgcagctcagtgcctatgatgtctaggcaggagactacctctcgtatagttggtctcattccaggattgtggttgacacactggcatgcaacttcaagtaccttcagcatctgctcttcatgtcctgtgcctcggagtgttggatccaggacctcaatctgctttcctttggatctcatctcctggacccactcgatgagttcttttgatgcagacaagactggaatgggtcgcctcccggtgagtagttcaagcaggacaaccccaaaactgtacatgtcacctctcagtgtagccatccacccttgcccatactctgggggaacgtaaccaagagtgccaactagttcagttgtgacatgggttttgttgggaaggatcaatcttgataacccaaaatctgcaacataagctttgaattctttgtcaagtagaatgttgctggacttgatgtcacggtggactatgtttggcttacaaacatcatggatataagcaaggccctggcttgccccttgtgcgatcttgagtcgcattggccaatcaagaaatgaactggcatcgttgtccctgttgtgaagccaatcgtccaggctaccattctccatgtaggaatatatgaggaaccttgagtttccctggatgcagtaaccccacagtggcacaagattatcatgctgtgccatggagagtgcatcaacctctgcactgaattccctttccatcagacacatgtcactattgagcttcttgatggcaagcattgagccatcagatagctcacctttgtagacaagtccgtaacctccacaaccgatgatgttctccttgtcaaaattttttgtagccttcaggagatcagtgaatgtgagcttggtttgctccccctttccttgtggtaccatcaccaagggttgttctgaattgaggttggacgatggtgcttctgtcccatcattgctgtatctcctgtttttgctcaagaaacttgtgctcctcaacaaggtaaggagatgagctagcaagacaaggatggcaattcctccaaagaacacaccaaatgtaactgcaagaatggctttcttgatgtgtcgttttttggagatgtatgatgtttgagctgaactgcaatggtttgcaagcataggaccacataattttggattgccatcaaagatagaacttgggaatgtgctaagctgacctacagttggaactggtccttctaggtcattgttagaaacattaaatgctgaaaggaagtgcaatttgttcagtgcttcagggattgtaccagtgagattattgtttgacaagtcaagcatctgaagatttgtgagattgcagattgattctggtatctgtccagacaatttattggagctcaaattgagtaaaagaagtgccttcaactgaccaatctccttagggattgcgccagcgaagttattgatgcctagattgagcactttggggaaagcactgtttattcggtactgaagtgattgggctgtaaaaattggcagctcaaagacttttggtgcaacattgtctgtttttagcattggcatctccattaatgctgttggaatttctcctgaaaggctgttgttcgttatgtctagatagaagaggaagtttaggctgctgatccagataggtatttgtccagttagttggttgtcatgtaaaaataacatctccaaatttgtgagctttgataaccaatgaggtattttcccagacaatgaacaaccatacagggaaagaacctgaagattctcaaaaccatcaatgctatcatctaaaggtatggtttcgtgcatgaagttgatcgcgattatcaaggttgtgaggtttttggagctctgaagcatctgaagtgtactggttatatttgcaagagagttcttaacaagtgacaggaatgataaggacttcagattacctattttctctgacagctgcccacgaaagttgttgaaagataatcgtaatgcagttagattgctacatgagtaaatgctttctgggatcgtcccattgaatttattccacacgacatctaaagtttttagattgggtagtgtggagaagttaaccttggtgagctccccactgaagttgttcttttttaggtcaatggttacaaggtttgtgcagtcactcaacgttgatggcagctcccctgacatgttgttgttgtccagatggaactcctccagtctcttgagctgtcctatggaatgtgggatgctgccaatgaacttatttcctccaagatcaagggtgaccaaatttatgagcttggtgatgccgtcaattgatccttctaactgattgttaggaaaagagaggtgcttcaaagaggtaatatcaaagatctcatatggaatagccccagtgagattgtttttgccagagctgagcaatgtcagtgtggaacaattactgagccctggagggatgcccccactgaattggttataactaatatcaagcaaggcaaatgatggtgcactggcacagaacgaagttggtatcttcccagtaaagctgttattgctggcgttgagcgctacgagactcttcatcacctcccatgttgttgatggaaaatttcctgtaaacaagttgcttgatatgtttagtacctgcagaggccggtcatgggtcgaagatggcagatcgcttaagtctcctgtcaggtagttaaaactgacatcaaggatcatgatgctgctggatgacaccaattccagtggtaagccaccagacagtgagttgtgggacaagttgaggcgcatcaagcctatcaggttgccaagggaaggtgagatgatcccctcaagccctctagtagccagaaacacctcattgactgtcctatttgggttgcaggtgatcccttcccatacacagcagtccgtgccattcttccatgacatgcccaggccaccatcctttgaaagccaagcgagaaactggatcagggagttgctctctttctcggtgcaagaactggtgggagaggccaagaagagcagcagcgcaagagcaagaccaaaggaagttatggggaatctgttgctgtagttcttgttcgagaactggaggggttgcatggttttctccataacctagcatcagagccaatagtttgaagaagaatgatcatgatatgaagggaacaagcagctgctgcctcttctttgttttatcttctcaggtcaaaatcaccacatttatgagtcaggactaagctgctattggttagatgtgacatcactttccaaattcactgttcacaccagcaagctgctatagtctactggtaagtctgacttccattcactaatggtttggtaatacttataacagacatccatgattcggccattattgaacttttgtagcgtgcgttaatttactcgatatgacaattatacaagtttcattatgtttaacttttgctattggcataaacatttaagactaacaaagatgaatagaaaaaaaaatccctttttgctgggcaagaaagtggctctctcaaaattgcaaggagctaaaagagtttcacgaaaatgaatgagcccgcaagcattgaccataccaatgaatatttgtctgtaactatcagtatatttcagcatgtcaggtaacttttttttctcgaaaatatgtcaggtaaggatcaaaaagaaaaatgtaggtttttttttcacaaagtggttattacagtcccattaggccatcaccaagaataaaatgtttatccatttgcttcctttttttttattcgctaggattttttttttctgagaatatgttagttttgtgctctctaagaaaacaaacaacaaattgattcatatattttgttactacatggtaatcatgtgttgagctgtcacttattaaattcctggtatttgcctcttgaatcatgggctctcgataatgttgtgaatcttcgtgttgtttatcgaattctaactacagaatagttacaagaagggaaaaaatgggtttgaattacaaaatagtaaaaaaagataattcatgagagactgtgcaaagtacagtgcaacactcagcttctctctgcactctaaagtagatcatcatgtgttatctaattctattttaattgagttttgttgtctgcagctcggtgcctatgatgtccaggcaggagacaacctcttgtatagttggtctcattccaggattatgatttacacactggcatgcaacttcaagaaccttcaccatctgtttttcatatcctgtgcctcggagtgttggatccaggacctcaatatactttccttcagatatcatctcctgcacccactcgacaagttgttttgatgaagacaagattggaacaggccgccttccggtgagcagctcgagcaggactactccaaagctgtacatgtcacctctcaatgtagccacccacccttgtccatactctggggggatgtaaccgaaagtgccgactagctctgttgtgacatgggttctgttgggaaggatcaaccttgatagcccaaaatctgcaatgtgagctttgaattctttgtcaagtaaaacattgctgcacttgatgtcacggtggactatttgaggcttgcagacatcatggatgtaagatataccctggcttgctccttgtgcaatcttgagccgcattggccagttaagaaacgagctggcatcatcattcctgttatgaagccaatcatccaggctgccattctccatgtaggaatatatgagcaacattgagtttccctggatgcagtaaccccacagcggcacaagattgtcatgctgcgctgtagagagtgcgtcaacctctgcactgaattccctctccatcagacacatgtcgctgttgagcttctttatggcaaccatcgatccatcagataactcagctttgtagactagcccatatcctccacaaccgatgatgttctccttgtcaaagttttttgtagccttcagatcagtgaatgtgagcttggtttgctctccctttccttgtgacagcatcaccaaggtttgctccgacttgatgttggacaatgtttcttcggtgccatcgtttctgcatctcctgttctcagtcacgaaattcttgcccctcaagaagagaataagacgagctagcaagaacaggatggtgatacctccaaaaaatacaccaaatgcaagtgctaagatggctgtcttgttatgtcgctttttggagacatacgatgttttatctgaaccacaatggtgtacaagcataggaccacacaattttggattgccatcaaagctagaattcggaaacgtgctaagttggcctacagttggaactgatccttctaggtcattgttagatacattaaatgctgaaaggaagttcagtttgttcaatgctgcagggattggaccagtgaggtcattgcttgatatgtcaagcacctgcaggtttgtgatgttgcagattgattctggtatccctccagagaatttgttggagctcaaattgagtaaaagaagtgcctttaactgaccaatctccttcgggatgacaccagtgaagttattgatacctagattcagcacttttgggagagcactggttcttcggtattgaagtaatggagctgtaaaaacaggcaactcaaagacccttggttcaacattatctgttttgaacattggcatctccattaaggcttttggaatttctccggaaaggctgttgctcgataaatctagatagaagaggaagtttagactgctgatccagtcgggtatctgtccagtaaattgattattatataaaaataacaccgccaaatttttgagctttgataaccaatgaggtattcttccagacaacatacaattggccagggaaaggacctgaagattctcaaaaccatcaattatatcaccctctggcattgtttcttgcttgaagttgcgaccaatgagtaaggaggtgaggttcctgcaactctgaagtacctgaattgtccttgtgatatttgtaagagagatattaacaattgatagaaaagagaggtactgcagatttcctattctctctgacaactggccatggaacccattgtaagacagccgtaatgcagttagatttctgcatgagtagatgctttctggaactgttccagaaaaattgttccaaacgacatctaaagttttcagattgggcagtgtggagaagttgacattggtgagcttcccgctgaagctgttgctcttgaggtcgatggttacaaggtttgtgcagtcactcaaagtccatggcagctccccggacatgttgttgttgtccagatggagcttctccagtcttttcagctgtcctatggaatctggaatgctaccaatgagcttatttcctccgagatcaagggtgaccagatttatgagcttcatgatgccctcaattgatccttctaactgattgttaggaaaagaaaggtgcttcaaagaggtaatattgaagagctcatatggaagggtcccactgagattgtttctgccagtgctgaggaatgtcaacttggagcaattaccaagccctggagggatgcctccactgaattggttattactaagttcaagcaaagcaaaggatggtgcactgacacagaacgaagttggtatattcccagtaaagctgttggtgctggcattgatcgcgacaagactcttcatcacctgccatgtggttgatggaaaaattcctgtaaacaagttgcttgatatgttcagtacctgcagaggccggtcaggggttgaagatggcaggtcactcatgcctcctgtcatgtagttaaaactgacatcaaggaccacgatgctgcttgatgacaccagttccagcggtaagccaccggacagcaagttgtgggacaagttgaggcgcatcagacctgtgagattgccaagggaaggtgagatgaccccttcaaggcctctagaagccagaaacacatcagtaaccatcctgtttgggttgcaggtgatcccttcccatgcgcagcagtccgtgccattcttccatgacatgcccaggccaccatccttcgagagcccagtgagaaactggatgagtgagttcctctcttgctcggtgcaagaactggtgggagaggccaagaagagcagcagcacaagagcatggccaaggtaagtcatgtgaaatctgtttttgtggttcttgttggaaaaatggaggggctgcatagttttctccataggctagcatcggagccaatagtctgatgaagaaggaacatgataggaagggaacaaacagttgccatctcttctttgtttgatcattcaagtcatagtcaccaaatttatgagtcaggattaagatcttattgactaattgcagcatcgctttctaagttaactattccccacccgccactacagtttattggtaagtctgacttccacgcacaataattcgatagtacttgtagcagccatccactgattcagctattattgaactgtttttatcatgacctaatttatttgatctgacttctaccagcttcatcacgtcaatttttcgctgttttaacaatgacaaaactgaacagaatatttatccttttttgatgggcaggaaaaacacatccttttttttttggcgaaaagaagggacctcacagatttgcaagatcggattggtgaggtacatgacaaacaacatcattcagaaaaagaaaaggagcacatgttttgaagcagtcatcgatgtcaagatccacatgtgtacgggcatggaaagaacggattaatggaggaaatatttcccagggctctctcgttgaccctgaggcgtttacttttcttgccgttgtcagcatcaaagctttggttttggttaacatctaagttgcaaatggcaattggtttacgatggttttggcctttggactgcgactcttgaagtctagattagcagcaatgctggaccagactgcagcatcattagaggggctgagaatcgattagtcaggttaatggcagtgttcatgtgatcattagctggtatttcagtaaccagcaaaaagattgcttgcatttgtcttttcctttggcagataaggagtacttctgatgttgatagaatatgctgtttctatggctatgataatgtctgtcaaatacaaatgcagaagggcacaagtggctatcattaaaaatcaaagttacaaggagttaaaaataagtttcaggaaaatgaaggcggcagcaagaattgaccgtactcttttcatttttatctagtacttcctccgttttataatgtaagggtttctaacattaaccacattcgtatagatgttaatgaatctaaacacatatatttatatgaatgtgggtaatactagaaagtattacattatgaaacggagggagtgtaaattttgtctgtaactatcagtatgttcttttgccgggtcggccgaacgaggcagaccaaatttcattatggtaaaggagaatgtaaagaactataagcatattccagcatgtcaggtaatgaccaaacaagaaaaatgcttgtatggaagatattatatcagcttttggtccgtcactttcacagatcggtttagatacacagtcccatcactatgtgttaagttctctcttttctctaagaaaatgtgccaatatggctgtgtgcatccgttttgaatgtagatccgagttttaattcattttttaaaaaaataaatgtctggacagcatgatagcaaaatcgaaaagaaaacgagacaataaaaattaaaggaaaaggctaatgggctcacaattcctggccaactttattgttacagttgattagtcgatcgtaaaatagaaaacataattagcatatagggcttagtgccataccaaaacattagtaatcaatactttgggctctgatagctgcagtcagcaaaccaagcctcctgttgcaactacagaaaattagcgcgcgttaggttggttggctgcagttgcactgctacagccaacaataccgatcaacctcttggtagggtaaaattcttagtaatgtgtttggattgataccaattaagagtcaaattttatgttatggtgaagaaagttttataactataccaaattaagcatgtgcattactatctattcggcttcaaaccaaaccatcatatttactattcaaactaacaaaatattggcatcgcacattttggcatcatccaaagtggcccataattagttgaatattaactgttaaaaaataaaaaaagttttatttaataatttaagtaaattatatatataaattttatttttaacaaaacatatcttttaacaatttttaaaaaaacttgctaatgcgttttagaagttagaacagaccctagtataatttttatccactcaagtcattcaaagtacggtgatatgagtgggacctactacaagtaacttgcactgtgaagcatgtagctcagtgtgtgtgtatatatatatatatgaaaatgattctatacacataggagtacgtacacctgctcccatctaccgtccatcgtagcaagccccgataaagcccggatgcaccgaacggatccgttttcatttttaacgagaaaaaaaatccgtaatctcaattaacccgtggtaatcggaaaaccggatcgataaataccagctcattgggtgatctcgataaatcagttatcagtggagagctcgatattcggaggggttggcagcgatgcgacgagggcaggatacatcgttgatttggtgtccacggcgagtcggaagcgacggcgtgatccagagtatcataatatatatatatagggaatctaaagcattaaatatttttccttataaaaggaatcataataaggacttgaaattggtggaaatgagcaagtagtactttcttcggattccgatccagagtatgttcccattcacttgttaagaaaatggctatcaagaacgaattaaccctttattccttttttctttttacatacccctcgggcaaagaagaataggacaaaaaaaatatggaatgcaataaaaaaaagatctttatttattctttccgtagtttatccatattcatacaaaattcttcatgaactaatacccaactcttttcgtttattaattgttataacgagtgttttattccaagattaagttattgctgaacaaagaaaaagtaccattatattataaaggatgagatgaattccgaagcgttttttatcattctagcagacagaattcctttggtctaatttaggacgtttatatatatatatatatatatatatatatataatctacttggcatgtgaggaacgccaaatatcatgacactgtgaatggcctcatgccctcatagtatctctgggagtatctttggctcactggacgatgggcccaggactggttatctgcttcgatgctcacccgtgcagaattgcacacgtgttgctcccaaaaattggagtcatctccctcagctccggagacggcgaccggcgagcggcggcggcgtcatggtccctcttccgagcagcagtacggacatcgccggacaaccgagggtaaggtcagtttactcactctccgcgcgttcgcctctctgttcgttcgtcatgtgaggatttcgcttgctttaatgcgctgcgggtgtgggggtctagggtgtttctttagggttcgtggtgggtggggggcgatgcttgttgcaaacatgctcctccgattgatattcgtcgcaaaacgttgaacgattagactattagaggttgtcgttgcaaacgggagtgggtgaaatggttcctgccctaacattatgccctaaaaagtgatgatgaattttggtgtctcgattcatacccctgttagcctttgtttatgcgcattcttgtttcggtatttataccctggcattctggtgaaaattgtgatgcatccttctaatcctctattgccacagtttcctttttttttttctttgcacccaatcaaggaagaagcgtctactttttacaccgtcaaattgccgagtttgcgtggtacctttgggagagggcatttgtgcccctggcccgtgcaatttacgaacatgttattctgcaatttgattcatatttgaggagttattttttgaataataaatgggatcctgaaaactaacccacctcgaattcaaatttattcgagatacgcaaagaacattctgaggatggatgatgtgtgttcataacctcttaggactttttttttcatcatggtatacattttaccctgataaagggagaaatgaatctgtcaaaaagctgtacaaaggattagactggagtagtcattcttgcaaattacatgtactatgtgcactggtatacaagataatcctgtataactgcatcctatcttaagttttgactgaattttgcatctgcagtttggcgtctatactgtccaagcaggagactacttcctttatagtcggcctcatgcagggattacagttgacacacttgcaagcagtttctagcaccttcagcatttgctcgtcatatcctgtccctcgcagtattggatccaggacctcaatctgattcccttctgatttcatctcctgtacccacttgacaagttctttggatgaagacaagatatggacaggtcgtcttcctgtgagcagctcaagcaggacaactccaaagctgtaaatatcgcctttcaaagtagcaacccatccttgtccatattcaggtgggatgtagcccagagtaccaactagctccgtagtgacatgtgttttgttggcaaggattaatcttgctagcccgaaatcagcaacataagctttaaattctttgtcaagtaggatattgctggacttgatatcacggtggatgatatgtggcttgcaggcatcatggatataagaaagtccccggcctgctccttgggcaattttgagccgcttcggccagtcaagaaatgtactcgcatcatcgtccctgttgtgaagccagtcgtctaggctcccattctccatataagaatatataaggagccttgaatttccctgtatgcagtaaccccacagtggtacaagattgtcatgctgtgccatagaaagtgcttcaacctctgcagtgaattctctttccatcaggcacatctcaccaaaaagcttcttgatggccagcttggtgccatcaggtaaatcggccttgtatactagcccgtagcctccacacccaatgatattctccttgtcgaagttatttgtagccttcacaatgtcagcaaaggtgagcttgtttttacctcccttgttttgtgatactataactaatgattgctctgaatcagacttgtgcgaagttgcgtctacatctgcattctcgctactcctgttgttggttatacaatctgtaccctttacagtggcaagaagatatgccagaaatagaagaacagcaattcctccaaagaagacaccgaatgcagttgcaaaaatggctttcttgttgtgactttttgtggaaatggatgctgcttgttctgaacgacaactgcgatgaagaatatggccacataactttgggttcttgtaaaagctagaatttgtgaatgtactaaactgggctccatttggaataggcccttcaagatcattacaagaaacattaaatgtagaaaggaagtgcaggttgttcaatgctgatgggattgcacctgtgagatggttgctagacaagtctagcacctgcaaatttgtcaggttgccgagctgctgtggaatttctcctgataaattattcgaacttaaactgaggatgtcgagtgatttcaactgaccgatgtcttgagggatcacaccactgaagttattattgcttagattcagcacttttgggaaagcactggttatccggtattgaaagcccgctgcagatctatatataggtagctcaaatacccttggatccaaacgggtggtattcttctttgttattagcattggcatctccattaaagaagctggaatcccccctataaggctgttatttgataggtctagatggaacagtgactctagtcttttgatccaaggaggtatagatccactgagtcgattatctagcaaaaataacatctccaacttttctagcttcgacagccataaaggtatatttccagacaatgagcaattagctatggaaagaaccttaaggttctgaaaaccatcaattgagttatcttctggcatggcttcgccatagaagttggtcccgataagaagggtggtgaggttcctagaatccttgaggatccatagcatgtttgtgatatttgtcaagttgttgcaaccaaccgataagaaagtaagggacttcaaattacttatttttggcgaaagctgaccttgtaaattgttactagataaccgaagtgcgaccagattggtgcaagagtaaatgctttctggaactgtaccttcaaatttgttgcccatgagatctaaagtttttagattggacaggttggagaagttcacattgctaagattgccgctgaagttgtttctcttgaggttaatcgttatgagatgtgtgcagttgctcagggctgatggaagctccccagatatgttattatcacccaaatggagatcttgcagccttttgagctggcctatagagtctggaatccatccggtaatgttattcccctcaagatcaagagttgacagatttctgaggttcactatgagtgtaccattaattactccattcaactcattatttgggaaagagaggtactccaatgaggtagcgttgaagagatcacccgggagattcccgctgaggttattgtgaccaactttgagcactctgagcttcaagcagttaccaaaaccaggggggatgctgccactaagatgattataacagagtgcaagcgctgtaagggatgctgagctgctgcagaaattactcggtatgtgtcccgtgaagctgttgttgctggcattcagcataaccagattcttcatcatctcccatgtggcagatggaaactgtcctgtaaacgagttgctcgagatgttcagtacctggagaggccggaccggggtggaagacggcagctcatgtatctctcccttgaggtggttgaagctgatgtcaaggacggtgatgctgctggacgccatcaactccagcggcaagccaccggacagcgagttgtgggacaggttgaggcgcagcaggccggtgaggttgccaagggacggcgagatacgcccctcaaggcccttggaagccagcgagacatcggtgaccgtcccatctgcactgcaggtgaccccttcccatttgcagcagtctgcggcattccgccatgacaccgcgagaccgccatcgttggagaggccagagaggaactggaggagggagctcctctcctgctctgtgcatgagctggtgggagaggccagagagagcaatagcagcagcgcaaaggcaagattgaacctaaggaaatctatgaaacatctattgctgcacttcttgcatgaggaatggagttgctgctgcttctgcatggcctccaagcaaatggtgcctacgcctgattctgattggatgtgcaaatgaaatggacctgatgatgctttgaggaagaggaggaagaagaaaacaaagcaagctgcttatgttgcagtcgtattcacaatatagaaaggaggattgggtcaagaataaggtgtagtggccacacatccacactgttgatgatgtgcacaattgccagtaagccactgcaggtgcagcttcctggttcacaccatataccagcacgtttcagttggagctgcctgccacaaaattttattaaaaatgtccaagtgcccaacctttttgtacaaaaaattgttgtctgcttttgcaatttgcatcctccctcgattatgtgattgttcaattggtattaaacaattgttttggtttacatgatgatatgagatgatattatatagtatgacatgtgttctgttcaccaactttacaatgacatcttttcagatactgcagtatgaagtggtaattgtttgtgctactgttgtcagtgttggtcattcccactcccactcacttggttctctgtggcctctgctccacttataaattattagcattggctaattgattcgctgtctctgtctgttctttttttatcccagaacaaatcggccgttgctaaaatttaaatattagataaatcttaggctatttttaatgtagttttttttttcaacattaacttttaagtcagtaaggatacatatataaaatgttttattcacattacttgttagtcgctaataaatcgtttggtatttaggtagttcttggtcaaccgatggggcattatggattgtgtaagttgattataatcgtgtcatttagagacgccaaagctatagctagtcttttttccacgcaagaaagggggtacagctagtttttgaccaatcatttattaacgattccatcctgcgtctggagagctcttgtcctatatgtacatgaattgtttgttggtcagagagataactctagaagttcagattgctgcgtttcaacaaaaatgttcagaatttcaggttgccaagtcatgataacatgtggccacggaaatggttggacaaattgctgcagtagagtcaaattgctgtacatgagttctttttaacgaaaattgctatacatgagtagatatgcattatgggactatgccactgaaagtctgaaatagttcatgtaaacatccaaaatttttagattgggcaatttgaagaagctggccttgcctcatctccgctgaaatgacaaacaccacagttaaatttatgcaatggatgggttaattgactcaacggttactcccacagtttcagtaagaacgtaggatgttttgattttgttttaaattaaacttatttaaatttaactcagtttataaaagaataaagccaaacaattactacctccatttcatattataagtcgttgtgaccatttccttgtcaaagtttgaccaatattataaaaaaatattgcagcatttccaatacaaaattaatctattatcaaaatatatccaatgttatatttaatgaaactattttaacattatagatgttgttatatttttctataaatttgatgaaacataaaaaaatttgacttagaaaaaagtaaaacaatttacaatatgaaacaaaagggtatatcataaaaatgtattcaaggttaataaaattaatttggcattctagatattactatatttttttcataaacttaattaaatttaatttttttccaggtgtcgaggatcgtctcgtttggcgttggacatctaaccagcgctactcagcgcatttggcataccaggctttcttccatggccaacattcctttgcctgtggtgatcttctctagcacgcaaagggttgctaaatgcaggttcttcttttggtttgctttccagcagcgctgctggacggctgatctcctccagaagtgtggcattgatagtcactcagcctgccctttttgcgctcaggatcttgagacggcgaaccacatcctcctcgactgtgtgtttgctcggcaggtctggctccatgtgctgtcgcctcctggctgggctgccctctctccccccctgtggcagctggttccaggactggtggtcgtcctccagggcctgcttacctgagcatctccggcgctgcttcgactccctggtgctcctggtctcttggcagctatggaaggaacgaaactctagggttttcaactctgcgctctcttcggtctcagtggttctggagtccatccacccagagggctatctgtggtctttagctagcgttgccgcttttggggacttgttgggagtgtagagtggctcgaccccttcctgctgcttggagtttgtatttagccgccgtagttttaagctccaacttcttttttgcttttttccccttccctctacataagccggtctggctgattgcgtcgtgtaactataactcttttcttctaatatattgacgtgcagtctttttgcgcgttcgcaaaaaatttaaaattttttacttgggacaaaacccaaaatagaggaagtagattaatacagagcaatcaattgtcacgcacgacgcaccctaagccccactattttaaccgtccgatcgtccgtgtacggtttggatcaaacggtcgcgggagattcatgggaaaatttacgtggaagccctcgaagttctctccattactacttctgtccctttttatgcccttactgagttgggccggaatacatgggcctcctccagtagtcgaggtggtcgtttccatttgggcccaacacgagacaatcttttcgttcttctcacagactagcggcggccggcgggggaggtcaccgcggccgccgccggcgacggcggcggctgcgggattgctcctcccggaccgctgccgcgcgcccgcgatgcccttgaactgttctacgacaatgccagggctggcctggtcagagtggaggcgcttcccttccctgtgaggtggcgcactcagggtgttcggcgaaatgctcgagtaacttgtaccgggcggcagcgagcgtggccataggcgccggaggatgacgccgcgtgtgtgcgttccgcaatgccacgctctcttcacgcgcgcgagtcaacctccttcgagatggttagtcgttctgcattctcttcccactccatactagtgcctagcatttgtgctggtcttttatccacgcatttcacagccaactgcaaatctgtaatcgtatctatacgtctgacaatacctagtatcttcacttgaatgggaaccattttgatttttgcattgaaaaactcaaggaacataacaatttcctcacttgtttcgaccttttttcatgcctgtgcaacctgagaatgaacaatgtttaataaacagggaaaggaagacgcattacatacccactttctaatgtaaaaacaagtacagtaaaaaagggaaatgcctcaaaatcacactagcctgtcacacgctgtacagaacgaactataagatcaatcaaattctagttctagtgaaaccagatcaactctgttcacttaaagtacaagattatctatcatattattgcatctttaggtcagggtctatactgtccagactggctactacttccatcatagttggcctcatcaaaggattaccatcaacgcacttgcaagcagtttcaaggacctttagcatttgctcttcacaccctgtgccttgaagtgttgaatccagcacctcaatctgctttccctctgatatcatctcctgtacccatgggacaagttcctttgaagtagatagtattggaactggcctcctcccagtgagaagctcaagcaggaccactccgaaactgtacacgtcacctttcaatgtagcaacccatgcttgcccatactcaggggggatgtaaccgagagtgccgactagctcggttgtgacatgagttttgttgggaaggatcaaccgtgataatccaaaatctgcaatataagctttgaattctttgtcgagaaggatgttgctagatttgatgtcacggtggacaatacgaggcttgcagatattgtggatgtaagaaaggccgtggcttgctcctttcgctattttgagccgtcttggccaatctagaattgtgctggtaccatcgtccttgttatgaagccaatcatccagactgccattctccatgtaagaatatatgaggagcctcgagtttccctggatacagtaacccaagagtggcacaagattgtcatgttgtgccatggagagcgtttcaacctctgcactgaactccctttccatcaggcacatttcaccattgagcttctttatggcaagttttgagccatcaggtagctctgccctgtagactaatccataacctccgcatccaatgatgtgctccctgttaaaattatttgtagcttccataatgccagtgaatgtgatcttgtcttctgcttccttgccttgctgcaacattactaacaaatgctctgaactgatgttggatgataatgcttccgtgtaatcattgctgcacctatttttggtcctgaaactcataccactgatcgaccaaaggagataccctgacaacataagaatgacaatggctccaaagaagacaccaaaaacaattgcaagtatgaccttcttgttttgttgtttctttgagatcaaatgtccatcagctgaactgcaatggcgtacaagcataggaccacacagctttggattgccataaaagctagaatttgtgaatgtatcaagctgaccaccagttgggataggcccttctaggtcattgtatgagatgttgaattcggaaaggaagtttagattgttcagcgcagctgggattgtaccagttagattgttgcttgacaaatccagcacaagcagatctgtgaggttgcagatcgactgggggatatctccatataatttgttaaagctcaaattcagtgaaaggagcactttcaacagaccaatctctggggggatcaaaccggtgaattcatttttgcctagattgagcactttgggaaaagcactggccttgcggtattgaagtagtgatgcagatatatatatgggtaattgaaatgctctacggtccaactgtgctgcagccctgtctgaccttagcattggcatctgtaataaggacatcggaatttctcctgtcaggctgttatttgatatatctagatagaagaggaagtttaggctactgatccagtctggtattggtccagttagtcgattgttgtctaactctagcacctccaaccttgagagtttcgatagccatcgaggtatttttccagataatgagcattcacttagggatagaacctgaagattctcaaaaccatcaatactgccatcaggcattctttcattcatgaagttgtggccaataagaagggtggtgaggttgctggagctgcttaatatctgaagtgcatttgctatgtttgtaagacagtttcctgcgagtgacaggaaggagagggatttcagattgcctagtccctttgataactggccgtgcagcttattggaagatacccgcagagcagttaggttgctgcatgtgtatatgctttctggaatttcaccactgaagttgttccgcataagatctaaagtttttagattgggtaagttggagaaattgacatagatgagctctccactgaaattgttgttattgaggtcgatgattttcagacttgtgcagttactcaagtttgatggtatgctcccaaacattttgttgttgttcagatggagttcctccaatctgttgagctgacctatagactctgaaatgttaccactgaagttgttctctccgaggtcaagggtagccagcttactgagtttgacaacatttgcccattcaagtgtcccttgaaaatcattgtttggaaaagagaggcactctaacgaggtagcattgaagatttcatcagggatagtcccactaaggttgttgtggccagccttgaggactctgagcctggagcaacttccaaatccagggggaatgctcccacttaattggttataactgagttcaagcacagataagtatggcgagttggtgcagaaattagctggtatatgcccactaaagctgttgttactgacattgagtgcaaccatatttttcatcactacccatgtggatgatggaaactgtcctgctaacaaattacttgagatattcagtacctgcagtggccttgcaggtgttgaagatggcaactcgtcaagatctccatccaggcggttaaagctgacgtcaatggtgatgagactgctggaagacaacagttccttcggcagggcaccagacagcaggttgtgagacaagttgaggcgcagcaatccagggagattaccaagagacggtgagatgcgtccctggaggctcctagaggccagggaaacatcagtgaccgtgctatcttggctgcaggtgatcccatcccatttgcagcaatctgtaccatcctgccatgacgcagcgaggccgccatcttgagagagctccctgaggaacctgaggagggagctcctgtcctgctctgtacatgaactggtgagagaggcgaggttgatgagcagcaccagggcaagggcaagaacaggtatgggaaatttgttgctgtgtttcttgcacggagaatgaagtgggtgcatggttttcttgtgaatctagcatggaaacttgatgctgagtttgtatctaagtatcttcactgggaaaagcatcagatggttatatcaagaaagagcatcaggagtaagaaagagtgtctattggttccattttattttggccttctctgacttggggaatgcatcagatggtcatacctagaaggagcatcaggaggaagaaagaaacgtctataggttccagtttatttcagccttcttgtcattgtcatcacaaataaatgctggtcaatgatttgatgctatagtatatgggtactcattaagatttaggacctcacaaaaactgtcagtgcagttttgttcgtcgcactatggcgttccagtagcggctgccagttatactattggaaagtcaacttctcgacattggcggccgtaagtaattctctccgtagccatccttaatttttaaccttaatcacgttgacattgttacaacatgccttagtttacttgatcaggcatgacttctcttaccagcttcaccatggatctcttcggctcttcgctagctattattccggaccaaattttgacacaacgattgaactgaaggatgctgcatcacctttattcaacaggaaaatgcactgtatttgcgaaagaacaaaaataattgctgaagatttgtaagttggagagatagcactacatggaattaaagcgtcattccaagaagtgtatatgatttacagcaatcatcatgcatcggcgtcgcggtcatggtgtgtacaacaacaatgaacaactggtgagtggagggaccaaaactgctgctcccttcttcggcttgaatcttgaccgtttacttgctgactctgttgttatcaagcgtgcgctttggtttatttgctccacacgcttgcagttgttttccgctttccactagtatataatgtaggttttcgctcttatgcttatgcctatgtttatgaactaaaatttaaattttaaaattattcttatcttaaaattgattttgtggttttatttatcatggtttattttttttgtatcactaagaatataaaaattttaccattaaattatttttttctttgctaataaacgttacgaatagacgtaagataagcgaaacgatggatcacgagcataaaatcctaagcatgtgatggatgggtggatgactagttaactcagacgatcacttatgtccttttttgttttttgaaatgagattataaactgattcactgggctttgatctattgtcagataccttctctgcatcccgccgccgccgccgtggaggcgtggaggtgtgattatttattggagaatgggcgcggagcggtgaacggtcgccttaccgagcggtggccatctggtctcgtttcaacggttcggatcaagtcgcgcgtgcgagcgattatataatacttcgtccgttttataatgtaagactttctaacattatctacattcatatggatgttaattaatctagacagtatgaataatggtagaaaatcttacattatgaaacggagggagtagtaacattttgcacgtgagcccttagactactgtgcattcgtgcttaagggctccttaaggaatgagccctttagttttttaggaattttagagaaaaattagcatgaactcacacctcctggaagtctttgtatcactcttttctccaaatcctatagcgttttcatgtgaagcatccaaactatatgactagacaattcttgtgttctatgatttgacattatttaggatgagatggtattataccgtcctaattcctttgttttcctgttgcctgtgtttttgaattctgctttttaaagtcgttccgggtaggatcactaccaatagtagcgatctgtatgctgcttggatcaaggttacaggcaacctcatgatatttctacttagaccatgttttttttcttcaactctaaattttaattttctcgatttttgttagtacgtgttttaaaatgttaaataatgtgtgtatttgttaaaaaaaatatacagaagttgtttagaaattcaagtaaaactattttttttttaattttatgatagttaatatttaataaatcatgtactaaaacatttttctcgtttcgaatgctttgatttaatcattaataaagctctctctttcatgtaaaaaaaaaattcccagcagctacgaacaggccattaggaatttaggattccttggactttttttttttttttgctcttctttgagttgggccggaatacatgggcctcaactcctcaagtggtcgttcccatttaggcccaacacaatccacaggcattcgttcttcccccagaccggcggcgacaatgtccctctctgccgccgtcgctcctcaaatccctccggcgagtggcgtgctcgcggctccgtatcctgtcctggcttccgccaccacccccgcagcgctgcgagcttgctcctcccggcccgtgcctggcaactctgggggaagggtgggccgcttccctgtgtatcggcgcgctctcagggtgttcggcgaaatgctcgagtgtcttgccacgggcggcgggtgaccgtggccgtagaagagctcgtgcggttgagaatgtcgatcagggattggttggtgctgcgtgagttcgtgctgctccttcgagatggttagttgtgctgcattttctttccactccaatactccatgctagtgcctatcgtttgttctggtattttatctaggttacaaccaactttagtcatcatttctagaatgcgttgagcggaaacaaatggcgggcagcagctaaatcctaaatactctctccgtttcaaattacttgccgttctaggtttgtactaagtcaaacattttaatctttgaccatcagtttctatatattatatttttagattcatcataagacatactttcaaagatagatgtatttgacttaggaaaaaacatagagtgacaaataatttgaaacagatggagtatcttggtatcttcacttgaatggaaacaatttcgactctctcagtaaaaaactcaaggatcataaccatgttctcacttgtttgtactttttgtcatgcctgtacaacttgggtgtggatagtgtttcaagaaacagggaaaggaagagaatcacttaaaacactttttgatggaattaaacattcactaagcaaaaacaagtaacatcaatttgctgaaatgatattagtctgtcccaagctgtacataacaaactataagacaagtcagaagtactacttatagggaactacaaaattatctatcatgtttttataattttatatctttatttcagtgcctatactgtccagacaagtgacaacttccatgatagttggcctcttcaaaggattacagtcaacacacttgcaagcagtttcgagcacctttagcatttgctcttcgcaccctgtgcctcgaagtgttggatccaacacctcaatctgctttccctctgatctcatcttatgtacccatgggacaagttcctctgatgtagacaagattggaacagggcgcctccccgtgagaagctctagcaggaccactccgaaactatacatatcacctctcaatgtagcaacccatgattgcccatattcagggggaatgtaacccagagtgccaactagttcagttgtgacatgggttatgttgggaaggaccaaccttgacagcccaaaatctgcaatatacgatttgaattctttgtcaagtaatatattgctggacttgatatcacggtggacgatatgaggcttgcagacatcatggatgtaatgaaggccctgacttgctccctgtgcaatcttcagcctggttggccagtcgagaaatgagctggcatcatcatcccaattgtgaagccaatcgtctaaactaccattctccattaaggagtatatgaggagcctcagattgccctggatgcagtaaccccagaagggcacgagattggcatgctgtgccatggatagtgcatcaacctctgcactgaattccctttctgttagacacatttcactattgagcttcttgatagcgatcttggaaccatctggtaactcagctttgtagactagcccatagcctccacacccaatgatatgcgccttgtcgaagttatttgtagctttcacaatgtcagcaaatgtgaggttgatttcttctccctttcctcgtgtaatcattatcaatgaatgctctgaatcagagttgaatgaagctgcttctaaatcaccatcgttgtcactactatttttggttatgaagcgtttgctcctttctgagacaaagaaacaccctagcaacaaaagaatgcaaatccctccaaagaagacaccaaatgatattgcgagaacgatttttttattctgttcttttctggacactgaacttgcttctgctgaactgcagtggtgattgaacctagagtcacaaagctttgggtttccttcgaagcttgagtttgagaatgtatcaaattggcctccagttggaataggcccctctaggtcattgttggaaatattgaatgctgagaggaagttcagattgcttagtccaggagggatttcacctgtgagatggttattggacaaatgtagaacctggaggcttgtgaggttgcaaattgattgtgggatctgcccagataagttgttgaagctgaaatcaagcacaacaagcacttccaactgaccaatcattggggaaatcacacctatgaagttgttatggctcagattcaacaacgtagggaagccagtaagcgtgcggtattgaaatgatggcccgttataaacaggaagctcaaaagcccctgggtccaaatgggctatgtctgatgttgatcttagcattggcaaattcatcaaggtgatcggaatttcttctgtaagtctgttgtctgatacatctatatagaacaggtggtttaaggaatcaatccatcttggtattggtcctgtgagttgattgccatttaaaagtagcatctccagattcgtgagcctggataaccatagaggtattttcccagacaacaagcaactgtttatgtcaagaacttgaagattcccaaaaccatcaatactttcgtcctgtggcatgacctctcctctaaagttgtgcccaataagcagggtggtaatggtgctgcaacttttaaggatctgaagtgcttttgtgatgttagtaagcttgttgtcatcaagtgagaagaaggaaagatacttcagattgattattcccggtgacaactctccatggaaatggttgcctgataaccgtagggctgtcaaattgctgcatgaatagatgctttctggaattgtgccggtgaagttgttgaagtaaagatctaaagtttttagattgtgtagagcggagaaattgactttgccaagatctccactgaagttattgtgcttgagatcaatgattgagagatttgtgcagctgcccagagttccgggcaactcgccagacatcatgttgctgtccaaatgtaactcctccaatctcttcagttggctgatagaatctggaatcttgccaatgaactgattccctcccagatcaagagttactagatttctcagttttgctatctgtgtaccatcaatttccccatgcaaattattgttaggaaaagataggtactccaatgagacatcattgaagagttcacctgggagtgtcccactgagcttgttgtgaccagccttcagaactttgagcatggagcaattaccaagtcctgaggggatgctgccactgaattgattgtaacatagttcaagcacagataaatttgatgagctgtcacaaaaacgagtcggtatcttcccagtaaacttattactgctgacattgagggcgaccagatttttcatcacatcccatatggaagatggaaactgccctgtaaataaattacttgagatgttgagtacctgcagtggcctgataggggttgaagatggcaactcgttgagacctccattcagcctgttaaagctgacgtcaacgatgatgatagtgctggaagacaccaattcttgtggtaaggcaccagatagcatgttgtgggagagattgagacgcagcaatccagtgaggttgccaagagacggtgagatgttcccctgaaggttcctagaagccagagaaacatcagttaccgtcccatcttggctgcaggcgatcccgtcccatttgcagcaatctgtgccgtcctgccatgatgcagagaggcctccatcctgagagagctccctgatgaacttgaggagggagctcctgtcctgctctgtacatgaactggtgagagaggcgaggttgatgagcagcaccagcgcaagggcaagaacaggtatgggaaatttgttgctgtgtttcttgtaatgaagtagctgcatggttttctggtgaaactaacatgaaaaacctgatgctgagctttgttcctgactggataggactaatcaatgaagagcatcaggaggaagagagaagctgcccttgcttccattttattctggtatactagtcgtaatcataaaaaagaaatacatgtcaaagattaggtgatatagcctatggatattcattaggacttttacagatactgccacaatatcttcttggcaaaatatggttatatagcatccagtttcgcctgtcttcttcggtatgacgtctcactagcgagtactattgaaacatcaagtggccgacctccctgatcgtgcaagttatttccttttgtttggaccattttttattttaatcgttgtcacattgacattgttacaacatggattaattgactccatctgacatcacttctcttaccagctgcacccctgaagccatgaaagacctgttagcttgccagttgccactgatgcgtacaaatttgttcatccttgagaagatcaaggagaaacgcccagggatcttccgactagttccacaaggtggtgggctagccggcgttggttcgaaatctcaccccttctatttatttgatattaggttcttccctaatattcacgtttttcttctgtgagaagatcaagaaacacagctggtgaagatttgtaagatcagctttgcaggtggtacatgggaagcatcattcggagagttgcatataatctagagcaatcatcggcgtcgcggtcgtggtgcggcacatgctctggacaccaacaaacacagctgattggttggtaatctggtgactatctcgtctctattattattgttgttgttgttgttgagacgatcacgcaagggccaaggcgtttactttctgctgtcaagcgtgcgcgttggttggcttatttgctccacacgttcagctgttatccatccttcaggcttcgccgttgtatgactgttgacccatggaggcatggactattatgacgctttgtggttgtggatgccatctgaattttggaagcatatcccctgtggatgccatctggctgatcacttgcatagttgcatcgggatttaggacaccacaggggatactggttgatcacacataatcatcttatgtattcttccgttctaaaataacttaaccgataatagaatatgacataacttagtacaataaatctataaacggattacgcaccaacaggctaacccttatgggcctacacgtcagaggtaagtagaagagcctcatcggtgtagacatggttgaatgtagagtactcttgaatgtacttcctggacctggagctacacaagccttagtttaattgaaccgttgtgtaaaaattgtattttttttaagtcatggtcatatatttctttttctgtttctaattccagtttgcgtacgaggtatttgcaaatttactcatttatggtgtatatatgaagtgtaattccaatcgttctatgcgcaaaggttatactatactatcccttaccatctctgtttatatgatcataattcaatttctgctgttctctaacaaacgacggcatgtagggaaaaaaaaacaattctaattggttagacttcggctgaaatccgtagaaaaatgaacgaggtattacaattttttttttgtggtttaaaagccaagaccgaaaagaatagactaccatataaaaaccctaaaatcaactaaccataccaaatatagtttagggtattgtgaacttttttttttttagaattgtattgttaacttcttttttttttgacacggataactttagtttccattaaccagcagcctcggacaaatcgccggagaggcggagaccaaactagttacaaactccggggcttggctccagtaacaagttgagccaggggccacggtaacagctccataggaggccattcgatcggccaccttgttacagattctagggcaaacagatatcaaaagaagtgattaacagggccctaatgattttgaacaaagctccatctgcactccgatccatctcctgggaagaaattgtattgtgaacttagagtaagtttaatagtatagccaactactagctccaattcatctataaccaatctaatagctcattcatacaatagttacatactacactattaatatctagtctcacctatcatacacacactgcgtcttggagtccgtgctataaatctgtagcccgctgcgcttctctctccttatttatctgcttaaaatatgtttgtagctggcttatagcctgctattgtaactgctcttattcctaaattttaactacgactgataagccaacgatgaaattaagttgggctggaatacatgggcctcgtgtggtcgtttctctccgggcccaacacgagcccgaaagcttcgatacttctcccagactagcggcggggaggcgaccggcggcgacaggtggccggctgcccgcggcgccgcggatttgccgtttgctcctcctccgggaccgtgtcaccgggcagcatgacgccgcgcgacggcgacgcggcgacgcccttcgactgttcgacgcaatgccagggggaggggttggggttggtctggtggaagtggaacggagccgctttgctgtgaggcgccttgctcagggtgttcggcgaaatgcccgagaggctgtccagttccggtcgggcgccgactgcggccgtcgaagatctcgtggaggtgggctcgtcgaccaggcgactgaggggccatgcttcgtgagtgcgtgccgacaatgccgcgctctcttcacgcgcgccagtgcgcctccttcgacatggtcagttgtgctgccttctctttcagctccatgctagtccctagcatttgtgctggtattttatcaacgcatttcacaaccaacttagcaaaatatcttggttagcagaatttcacaaccaacatggttagtagtgctgacctagttaattttttcaataacacattgatgatcggaaacaaactgcttatagcagaatatcttggtatctttctaacctttttgacgttgtttctacctttttgtcatgcctgtacaacttgagcataaatagtgtttcaacaaacaagtgaaggatcaaagcaagacgaattctttcagcactcaatgccctgaaatgatagtagtctgtcacaagccgcggagaacgaactataagacaagtcagtcagaagtactaattctagtgaaattacataaactcctgttgggtgaaagtacaaaattatctatcattgatgttatgtgtttcggtcagcgtctatactgtccagactagcaactacttccatgatagttggcctcatcaaaggattatagttgacacacttgcaggcagtttcaagcacctttagcatttgctcatcataccccatgcctcgaactgttggatccaggacctcgatctgttttcccactgatctcatctcctgtacccacgggacaagttcctttgatgtagacagtaaaggaacaggccgtcttcccgtgagaagctcaagcaggaccactccgaaactgtatatgtcgcctctcaatgtagcaatccatgattgcccatactcaggggggatgtaacccagggtgccaactagctcagttgtgacatgagttttgctaggaaggatcaaccttgatagtccaaaatctgcaatataagctttgaattctttgtcgagcaggatgttgctggatttgatgtcacgatggacaatatgaggcttgcatacatcatggatgtaagaaatacctaggcttgctccttgagcaatcttgagcctggttggccaatcaagaaatgagctagcatcatcatccctgttgtgaagccaatcgtctaagctgccattctccatgtaagaatatataagcagcctcgagtttccatgtatacagtaaccccagagtggcacaagattgtcatgctgcgccatggtgagtgcttcaatctctgcagtgaattccctttccatcaggcacatttcactattgagcttcttgatagctaacttggagccatcaggtagctcagccttgtagactaatccataacctccacaacctatgatgttctccttatcgaagttatttgtagtcttcatgatgtctgcaaacgtaagcttgttattgtctcccttgccttgtggcatcaccatcaatgaatggtctgaatttggattgaatgaggctgtttcttcatttctgttgttagctaattccccttttctcatcaactttgtagccctgagtgacacgaggagactactcagggataaaagaatgataatgcctccaacagacacgctgagtgtgattgctaaaataactttctttttgtgttgttttctggacactgaaggtgctcttgatgaatcacagctgcggaagatatttgagccacacagctttgagtttccaacaaagctagaattttgaaatgtactaaactgacctccagttggaatagacccttccagatcattgttagaaacattgagcttagaaaggaaatgcagattgttcagtgcagatgggattgtacctatgagatggttattggataagtcgagcacctgcagatccgtaaggttgcaaagcggttgtgggatctctcctgaaatactattgaagctgatattgagtgtccggagcatttttagttggccaatctcttgtgggattgcacccatgagatggttcctggctagatttaatgttgctgggaaagcacgaaatccacggtattcaagtgatggtcctgtataaataggaagctgcaggatccctgggtcaaaatatggtgtagaatttgctgatatgagccttggtatctccatcaaagctgttgggatcccccctgtcaagctattgtttgatatatcaagatagaagaggaagtttagtctgttaatccaggcaggtatttgtccagtgagttgattgttagataaatctaacatctgcaaattagtgagttttgataaccaaaatggtatgttcccaatcaatgaacagtcatcaattgatacaaattgcagattctcaaagccatcaattgtttcatcctctggcataagctcaccattgaagttcactcccataagcaaagtgctgaggctcctggagttcttgagtatctgaagtgtatcagtgatattcgtaagagaattgttggaaattgaaaggaaggagagggacttcagattgcctattccctttggcagctggccatggaatttattggaagacatccgcaatgcaattagattgctgcatgaatagatgttttgcggaattgttccattgaagttgttaagcagaagatctaaagtttgtaaattgggtagggtggagaaattgatcttggagagctctccactgaagctgttgctcttgatatctatggttttgagatttgtgcagttgctcagagtcgatggcacctctccatacatgttgttgtggcccaaaaggagttcctctaatttcttgagttcacctatagattctggaatcctgccattgaaattgttccctccaagatcaagtgtaaccagattacttagtttcatgatatgcgcactatcgagtgttccatttaaaccattgttgggaacagacaggtgctccaaggaggtggcattgaagagttcatcagggagagtcccactgagattgttttgaccaaccttgagcacatttagcctggaacaagctccaatccccgggggtatgcctccactgaacaggttgtaacaaaggtcaagcaccattaaggatggcgagctcgagcagaaatgatccgatatctgcccagtaaatctgttgttgctggcattcagtgcaaccaggttcttcatggccttccatgtggtggatggaaactgtcctgtaaacgagttgctcgagatgttcagtacctgcagaggccgaacagcggtcatcggagatagcgggtcttgcagctcccctctgagtcggttaaaactgacgtcgaggacactgatactgctggaagaaaccaattcccatggtaggtaaccggacagcgagttgtgcgataggttgaggcgtagcaggctagtaaggtttccaagagatggtgagatgtgcccttcaaggccctttgattgcaaggagatatcagtgaccgctccatttctgttgcaggtgataccttcccagacacagcagtttctatcattccgccatgacatggaaaggttgccgtcttgcgagagctcggcgaggaactggtgaagagagcccttctcctgctctgtgcaggagctggtgagagaagccaaggagatcagcagcaggagaccaaggctcagggaagatatggtaggtaatttgctgctatacctgtatgatggaaaatggagtggctgcatgattctctgatgaaactatgatcaaaacaagatgcttggcgtgtaaagaatcaattgtgtagtcaagaacgagccatgaggaggatgaaagaagccacttttgcttctaattttgttttggacttaccggtcgcagtccatccaggattagatatttagatgcaatagcctataaggagtacttgctaagttttcacaagattgatgcatggtctttgttaacgcgtgtgctgttaaattctctaccggttgactgtagaatgatctattgcacagtcaaccttcctgggtatactagctactaccggatgggatatatcatagtactacgaatctggacaggtctctgatactagattgctatattatggcacggatcaatatgttttttttttactgaagcattaattctttactcaatccttatcacgttgctcttgttacatcatggttaatatttgaccgtatatatcacttatgttaccaggttctccccagcttgtattttgtgataattcggttgaagatttgcaattgtgtacatggaaaatcatcattccgagaggtgcatataatttggagaaatcattggcgttgtggtcatggtgtgtacgcatattttggacaagaacaaattgagcacaagtggtggtggtgagtgggcgacccggtgtgttgctgtcttcttcttcttgaccgtttactttctgttatcaagcgtgcactttggcttatttctccacacgtttgcagctctttttccatcttctaccggctccactgttgtatcattatagaccatggattatgactggaaatttgggagaaatttgataatttgacactttattcattgttgttttgctttaattgatacttgtgcgaatgatatgtgggaccatctgagtgaatgaaagtgaccagaacatgatgttaaatactccaagcccacttttgtggaatgtcaagttgtcaaatctgtcgaaattttggaagcgtgaagaaaagtacaatgggtaccgtatgagggctggatgatgtggggcaagctatatcacttgggacatcatggtggagccctgactcttgtacagacatatgtggtctatggaacggactggagccacagaattgcactagaatctgggctcattttgcaagctggtgtaagacttgtcctcctttatcatggacatatttttctaattttaattccgatttgcttacgaaggtctgttaaaaagttcaggtgatatcatttcgatgctcggtagtaggtctagtgcacttcaattattttgttccattgtctttgggacataatgcaagtatgcaaccacctagacagtctttctttctttttttcatgatcatttttcttttctgtttcttattccaatttgcacatgagatatatgcagttttactcattagtttatggcttatatgaaaatctgtgattcgagtcgttatatgcgcaaaaattatatagtactaccttcatcctaaaatgttgctatctaatgtaagatgaggcactacctagtgctacgaattttaacaatgatgtctcatcttatattatgtagtacttactctgtttcacaatgtaaatcattttagcattttccacatttatattgatgtcaataaatctagacatatatatttatcttgattcattaacatcaatatgaatgtggaaaatactagaatgacttacattgtgaaacggagggagtaacattttgggatggaggtactatctcattcaccaaatgttgaggtaaccaacataaaaaaaaaaggagcgagtagtactacctctgttccaaaataagtgcaactatggatatccgtgtccaacgtttgaccgtccgttttatttgaaaattttatgaatttttttaaaaaattaattacacttaaaaggactattcatgttttatcatttattaacaataaaaatactaatcatattttttttcaaataagacgaacgatcaaacgttggacactaatatcgcaaaactgtatttattttgggacggagggagtactatcatctctgtttatacaatttataattgaatttctgcaatgatcatactagtgcttctgtccataaaatcatagacatcgccgttatgccaagggatggattcatcgattagccttaagttgggctggaatgtgtgggcctcgtgtggtcgtttcccttcgggcccaacacgagcccgaaagcttccatcttcttccagattagcggcggggggaggcgacggcgaccggcggcgacgggtggccggaattgcggttccgtatccctctcctggcttccgcccaccgcgccctttgactgttcgacgcaatgccagggctggcctggtggagcggccgagcggaggtggtggagccgcttcttcgctgttaggcggtgcgctcagggtgttcggcgaaatgctcgagaatctggccggcggcgagtccggccgttgaagatctcgtggaggcgaagggaccatgcttcgtgagtgcgtgctgcaatgccaagctctctccaagcgcttcggcttcgcgaggttagtgatgctgcattatctccccgtcccatgctagggcttagcatttgtgctggtgtggttcacttatctattctcttccggtattaagaatgcgttgatcggcaacaaacatctggcaacacctagtatcttcacttgaaccgaaaccattctgacttaatttctgagttaaaaacttaatgttctcagtcattgttacttttcatgcctgtgcaacttgagcacgagtagtgttcctaaaaacttttgtttagtttatatccatcacgcacatttcacctttgagcttcttgatggcaatcttggagccatcaggtagctttgccttgtatactggagttaatggcttaccacattcttcactatatcgatctttttacgtggttggtactctcattcttttgattgactagatgcgtgttcagcttctggtgatcacagagttttatccctaccaccccaaaaactgcgttgcattctcattctcttccatacttgaatcacacatttctggcatgtattcattagattcctgtggtttctatgtacgtcaatcagaaacaagagtgctgatatcacctaattgccttagcatttgcactcgatttgtttgagcacacaaagaacaggatgatttggcaggaggctggcctagtctagctctggttgtagacaagtgtagctcctagcgtttcactgccgtgaggcggtgctgccccggcaatttaagtttgccgagcatttatgtactaaactccttttaaaatctaatgaaattcagatggcgtccttctgccgtcccagcgaaaaaaggaacaggatgatcttttcacttgtttatacttttcctcatgcttttcgccaattgagcgtactcagcacttccttcagtggaggagaaatgtctggttatgaaactaaaaactcctgagaagatacaaaagtgcaaaatggtaatatgtcagcagctgtacacaacatgttacaagaccagaaaaactactactacgtaataccacatttgctctatgcactgagctacaattttgtcattgtataactgcaatctaccttgactgccttgtgccttctatatcttcagtcggagcctacactgtccaggcaggaaactacctctgtgatagttggccgcatgcaaggattacagttgacacatttgcaagcaacttcaagcaccttgagcatctgctcttcattccctgtgccttggagtgttggatccaggacctcaagcatgtttcccttggacttcatttctagtacccatggaacaagttcctctgatgtagagaggattgaaacaggccgtcttcctgtgagtagctcaagcaggaccactccaaaactgtacacatcgcctcttaaggtagcaacccatccttgtccatactcaggtgggatgtaacctagagtgccgactagctctgttgtgatgtggtttttgttcggaaggatcaatcttgacaacccaaaatcagcgacataagctttgaattctttgtcaagtagaatgttgctggacttgatgtcacggtggacaatgtgaggcttgcagacatcatggatatacgaaagaccctggcttgctcctcgtgcaatcttgaaacgtgttggccagtcaagaaatgagctggtttcgtcatccctattatgaagccagtcgtccaggctaccattttccatgtaagaatatatgagtagcctcgagtttccctggatgcagtatccccacaaaggcacaagattgtcatgctgtgccatggatagggcttcaacctctgctgcaaactccctttccatgaggcacatttctccattgagcttcttgattgcgagtgtggagccactgggtaactcagctttgtacactagcccataacctccacatgctataatattctccttatggaagttatctgtagcctccatgagatcagtgaatgtgagtttgtttgcttctccactgcctcgtggtatcattaccaacaaatgctctggatcagaggtgaacgaaccggcctccagatttccactagtgttgcttttgttttcgattttgggaattgcatccctgagcgagaaaaggaagtgcgccaatagcaaaacaattgcggcccctccaaaaagcaccccaaatactattgcaagaatgacccttttgttcaactgttttttggatgctgaggcttcttctgctgatttgcatttgtgagtgagcatagagccacacagctttgggttaccatcaaagctggaatttggaaatgtactaaactgagctcctatgggaataggaccttcaaggtcattgtttgaaacattgaatgctgaaaggaagttcaggctattcagttcaccaggaattgaacctgtgaggttgttattggataaatcgagaactcgcagacttgtgaggctgcaaactgattgtgggatctgtcctgataaattgttgtggctgaaatcaagtacgacaagcatttttaactgaccaatttgtggggggatcacacccatgaacttgtttaggcttagattcaacagtgtcggaaaagcagtacgtgtacggtattgaagaaatttaccatcataaacaggtagctcaaagaaactaggctctgaataggtcttattctgggttgttcttatcattggcatgtccatcaaggtaattgggatttctcctgctaggctgttgtttgatatatccagatagaacaggcggtttagtgagctaatccagtctggtattggtccagttagttgattgttggataaaaatagtaacttcaagtttgtgagctttgatagccaaagtggtattcttcctgataatgaacagtggtctactgagagagcctggagattctcgaaaccatcaatggtttcatcctgtggaatgacctcttccatgaagttgtacgcaataaacagggtggtaaggttcgtggagctcttaaggatctgaagagctcttgtgatatttgtaaaagaattgttactcaaagataggaacgagaggtacttcagcttgcctatttctgatgacagctcaccgtagaaattgttatacgagagccgcagtgcaatcaagttgctacatgagtagatgctttctggaactttaccactaaagttgttcatgtcaatatctaaagttttcagattgggcaatgtggagaagttgaccttgcctagatctccgctgaagctgttgctcttgaggttgatggttgtgagatatttgcaattgcccaaagccgatggaagctcaccatgcaagttattgttgtccaaatggagctcctgcaatctactgagctgacctatagtatctggaatcatgccactgaagttgttccctccaagatcaagtactaccacattactgagttttactacaggtgtactaccaatgtttccttctaaattattgttgggaaaagagaggcagtccaacgaggtagcattgaagagttcgtctgggagagtcccactaaggttgttgttgccagccttgaggactctgagcatggagcaatttccaagttcagggggaacgcccccactgaattggttgtaactgagctcaagcacagcgaaggatggtgagttggtgcagaaattagttggtatatgcccactaaagctgttgttactgacattgagtttgaccagatttttcatcactttccatgtggaggatggaaactgtcctttaaacaaattgcttgagatgtttagtacctgcagtggcctggcaggggttgaagatggcaactcatcgagacctccattcaggcggttaaagctgatgtcgatgacaatgagacttctggaagacactaattcctgcggtatggcaccggatagcaggttgtaggacagattgaggcgcaacaatccagtcaggttgccaagagatggtgagatgtgcccctcgaggctcctggaaggcaatgaaacttcagtcacggtcttatcttggctgcagtttatcccttcccattcgcaacaatccatgccatccttccatgacatgctgaggcccccatcctgagaaaaccccgtgaggaaattgaggagggtgctcttctcttgctttgtacatgaactggtgggagaggtgaagttgagcagtagcacaagggcaagaccaagaacaggtatgggaaatctgttgctttgtgtcttgcatgaagaatgaggtggctgcatggttttctggtgatactagcatggaagccttatgcttagtttgtatcctgagtttctgactgggcaaagcatgagatgatctaatcaagaaagagcttgaggaggaagaaagaagtggctcttgcttccattttcctagcacgtgacaactttattctgtttttctactcgaagtcataaaaaagaaatacaggtcaaggacttcataaaatcttctattgaaaagtctgagtggtctgcctccctgaccgtacaagttattttcctttaatcatttttatttatttcaattttcctttaatcatttttatttatttcaatccttatgacattgacattgttacagcaatcctaaattcacttgatctgacaccatttctcttcccttgacagatatgtttgcgtgctactaatacggtcatttttttacacaaggatgcataccttttggtaaggaggaaaggactcatgtctgtaaaaagaaacaaagcttctgaagatgcttgaagagtttaagtaagctagggtgtagtctagtgattgcagtgacctgagtaataccccaaggttctgagttcaaatcttcataggagcgaatttcagagattaggttgtttgcggggctaagttccctatttcaatggccgtatatatccagttggatgtagaggccgggtaaaaaatacccttctctaaaaaaaagaaggtagcgtgtgagggctgcaagtggcagcaggctgatcacttgggagttgggacaccacagggaagcatagaaaaactttattctgattgtacgagggatatcaagttcttgacattttgatatcaagtttcttgatacgacctatacaattccatagcaaaattattttagggcttgtttggattgaagctaatttttgccctaccaattttattacgattgtacgaggaatatcaagttcttgacattttgatatcaagtttctcgatacgacctatacaattccatagcaaaattattttagggcttgtttggattgaagctattttttgccctaccatttttttgacaactttaataatatcgcatagatatttggtttgctacttaattttggcaactcttaactagattgatgcatgaatatatgctttgcggaattgttcctttgaagttgttaagcataagatgtaaagtttgtaaaaattgggtaaggtggagaaaatgatcttggagagctctccactgaagttgttgctcttgatatctaatctatggtttcgagatttgtgcagctgctcggagtcgatggcacatctgatctctccatacatgttgttgtagcctaaatggagttcctctaatttcttgagtttacctatagattctggaatccctgccactcaaattgttccctccaaggtcaaggttaactagattacttagtttgcaagattgctgaagatttgcaaagattcacttggaaagatggtactacgttacatggaaatcatcattccgagaggtgcacataatttggagaaatcattggcggcggcgtggtcattggtgtgtacatggtttggacaagaacaaattgagcacaactggtggtggcgactggtgagtggtgacctggtctatttctctcatcttcttgaccgtttactttctgtcggaaaagcgtgcgctttggcttttttgctccacacgtttgcagcggtttcctcttctggttccaccactgtgactctgaattctcgtgagaaatttgataatttgacactttattcgttgtggatttgttttaattaatacttgagagaatggcacatgggaccattcggataaatgaaagtgggctataatgttaaataatcgaagcccacttttgtggagggcgaaattatcaaatctcatttttggaagtgtgtgaagacttgaagtaaaccggttagcgcgtgaggcctatatgtgacaggggcaagctggttgaacacttggaggtgggagggacaccatggtggaggctgattcttcgttcttgtgcagacattatcatttcactgcttttgggcataagcgaaacggtatatttacaaatgaaaaataatttgtaaataaaacttgtatatacgtattcttaacaatctaaaagtaaagactaaaaaataaaccatgatgaaaaaaatctcaaaatcaaatctaaatttaaagttgaaaattcaaaatttagctgataagtataagtatataagcgaaaagatgaggccgctggtttattgaaacggacgggagccacagaattgcacaagaatatggggctcattgaagctggtgtaacacttgccctccttttctttttatcatgatcatgttttgtaatttcaattccaatttgcgttttgagatccttctaaaaatttcaggtgagatcattttgatgctctatagtaggtgtagtgcccttcaattattttgttccgttgtgttgttgaccaatctttttgtaataatcatatattttttcctgtttctaattccaatatgcgcatgagatatctgcaattttactcatttattgcttgtatgaaatgttgtgattctaatcattctctgtttatacgatcattattcaatttctgcaaacattatattaggacttccgtctatacagagagtagatagacatcgcagttttcttttcttttcttctctttttttttgagagaagacatcagtaagacagtaactgtcttaagttaggctgaaattcgtgggcctcatgtggtcgtttctcttcgggcccaacacgagcccaaaagcttcccatcttctcccagaagattagcggcgggggaggcggcggcgaccggcggcgacagggtggccggatttgcggtcccgtctccctctcctgggcttccgccaccacccgcgggcgcttctcctccaccgggaagcctgccgtcgcgcgacggcgactcccttcgactgttcgacgcaatgccagggcaggcctggtggagcggaggcggagccgcttcttcgctgcttgaggcgaggcgttcagggtgttcggcgaaatgctcgagagtcgcttgtccagtcctggtcggtggcgacttcggccgtcgaagatctcgtgggcggcgactgtgcttccgcttcgtgaggttagttgtgctgcattctcttcccactccaagctagggctagtagcatttgtgctggtgtggtattcacgtattccgcaactaatgatagtcgtatctactacatatacaatgcgttcatcggcaacaaacagctgacagttgacaacacatagtatcttcgcttgagtagaaatcattttgacttaatttctcagtgcaaaactcatggaacataacaacattctcgctgcttgttacttttgttgtcatgcgtgtacaacatgagcacggttagtgttccaataaacaggaaaaataaaacacattacatgaactcttatctactactactaatatagtgaacggcaatgcctcaaaatgacattagtctgacataagctgtacagaatgaactaaaagaccaatcagaaatactagcactagtgagactagatcaactcagttcactgaaagtacaagattatttgtcatattattgtatctttaggtcaggccgtcagggtctatactgtgcagactggctactacttctatcatagtaggcctccgcaaaggatcacctttgacacacttgcaagcaatttcaaggacctttagcatttgctcttcacaccctgtgccttgaaatgttaaatccagcacctcaatctgctttccatttgataccatctcctgtacccatgggacaagttcctttgaggtagacagtatcggaactggcctcctcccagtgagaagctcaagcaggaccactccgaaactgtatacatcacctttcaatgtagcaacccatgcctgggcgtactcaggtgggatgtaaccaagagtgccaactagctcagttgtgacatgagttttgttgggaaggatcaaccgtgataatccaaaatctgcaatataagctttgaattctttgtcgagaaggatgttgctagatttgatgtcacggtggacaatacgaggcttgcagatattgtggatgtaagaaaggccatggcttgccccttttgctattttgagccgtcttggccaatctagaattgtgctggtatcatcatccttgttatgaagccaatcatccaggctgccattctccatgtaagaatatatgaggagcctcgagtttccctggatacagtaaccccagagtggcacaagattgtcatgtcgtgccatggagagcgtttcaacctctgcactgaactccctttccatcagacacatttcaccattaagtttcttgatggcaatcatagagccatcaggtaactgtgccttgtagactaatccataacctccacatccaatgatgtgctcctggttaaaattgtttgtagcttccacaatgccagtgaatgtgagcttgttttctgcttccttgccttgctgcaacattaccaacaaatgatctgaattggtgttcggtgataatgcttctatgtaatcattgttgcacctacttttggtcgtgaaactcatacccctgattgacagaaggagataccccaacaacaaaagaatgacaatggctccaaaaaggacacaaaaaacaattacaagtatgaccttcttgttttgttgtttctttgagaccaaatgtctatcaaatgaactgcaatggtgtgtaagcataggaccacacagctttggattgccataaaagctagaatttgtgaatgtactaaactgtccgccagttgggataggcccttctaggtcattatacgagacgctgaattcgataagaaaggttaaattgttcagtgcggctgggattgtaccagttagattattgcttgataaatccagcattagcaggtctctgaggttgcagatcgactgggggatatctccatataatttgttaaagctcaaattaagcaaaaggagcgctttcaactgaccaatctcttgagggatcaaaccggtgaattcattgttacctagattcagcactttgggaaaagcactggccttgcggtattgaagtagtgttgcatctatatatacgggtagttcaaatgctctagtgtccaattgtgctgcagccctgtctgaccttagcattggcatctgtaataaggccatcggaatttctcccgtcagattgttatttgatacatctagatagaagaggaagtttaggctgctgatccagtcaggtattggtccagttagttgattgttgtctaaaaccagcatctccaacctcgagagttttgataaccattgaggtatttttccagaaaaggagcatccacttaggtcaagaacctgaagattctcaaaaccatcaattctatcatcgtctggtatactttcattcatgaagttgttgctaataagaagggtggtgagtttgctggagctccttaatatctgtagtgcatttgttatgtttgtgagattgttgtaaccgagtgacaggaaggaaagggacttcagattgcctagtccctttgataactggccttggaatttattcaaagatagccgcagggcagttaggttgctgcatgagtatattgtttctggaattttaccactgaagatgttctgccgaagatctaaagtttgtagactgggtagattggagaaattgacattcatgagctctccactgaaattgttgctattgaggtcgatggttttcagacttgtgcagttgctcagggttgatggtatgctcccaaacattttgttgttgttcaaatggagttcctccaatctgttgagctgaccgatagactctggaatgttaccactgaagttgttctctccaaggtcaagggtagccagcttaccgagtttgacaacatttgccccttcaagtgttccttgtaaattattgtttggaaaagagaggcactctaacgaggtagcattgaagatttcatcagggagagtcccactaaggttgttatggccagccttgaggactctcagcctggagcaacttccaagttcagggggaatgctcccactgaattggttgtaactgagttcaagcacagctaaggatggtgagttggtgcagaaattagttggtattttcccagtaaagctgttgttactgacattgagtgcggccagatttgtcatcactacccatgtggaggatggaaactgtcctgctaacaaattacttgagatgttgagtacctgcagtggcctggcaggggttgaagatggcaacttgtcgagacctccattcaggcggttaaagctgatgtctatgacgatgagtttgctggaagacagcaattcctgcggtaggacactggatagcaggttgtaggacaggttgaggcgcagcaatccagtcaggttgccaagagatggagagatgtacccctcgaggctcctagaaggcagtgaaacatcagtcacggtcctatctgttctgcaggtgatcccttcccactcgcaacaatccacgccatccttccatgacatgctgaggcctccatccttagaaagcccggtgaggaaattgaggagggagttcttctcctgctctgtacatgaactggtgggagaggtgaagttgagcagcagcacaagggcaaggctaagaacaggtatgggcagtctgttgctttgtgtcttgtatgaaaaatgaggtggctgcatggttttctggtgatactagcatggaagttggatgcgagtttgtatcctgagttcctgactgcgcaaagcatcagatggtctaatcaagaaagaacatgaggaagaagaaagaattagctccaacttccattttattctgtctttctagtcatggttataaaaaagaaacacaggtcaagaactttataaaaaagaactgctatagcagcttcttggttcacattatgacgttgcactagcaggtgcctgctatatatatatatattgaaaaaccaagtggtcggcctccctgaccgtacaagttgttttccttttaatcatttttatttcaatccttatgtcattgacattgttacagcttgcctaaattcacttgatctgatgtcatttctcttccccttgacagacctggttgcttggtactaacacacacaaatctttacacagcttctgaaggacgcataccttttggtaaggagcaaaagactcgtctctgtgaaaagaaacacagcttctgaagatttgcaagatccactttgcagatactacatgcaaagcatcattccgagaggtgcatataatttagagcaatcatcggcatcgtggtcatggtgtgtacatgctctggaaaacaacatagcacgactggtgggtgattgggtgggtaatctggtgctctcttcttcaattcttcttcctgttgacccaagggccaaggcgtttactttctgttatcaagcgtgcgttccggcttatttgctccacacgcttgcagttgttttccattctcccggctccactggtgtatctttgtagaccatggattatgactcttgtgtctatctctgaattttggaagtgcttgaagacttgaagtaagctgcgtagcgtgtgagggctgcaggctgccagtgggagctggcttatcatttgggacaccacaggggagactggttcttgtgtagacatggtctatggactatggaacggactgaagccacacagatcttcaggtttgtgagaattccatttcttccttccttcttttgtcataatcatatttttcttattttaattccaatttgcatacggagctggtttaaaaaagttcaggtgagatcatttgatgctttgtagtaggtgtagctgcactttaattaattcgtcccattgtctttgggacataattcagccacccagaccttaatctttttttaaggggcacccagacggccagaccttaatttagctgaacagttgttgtttcgaaaggcatttatctgcagatgagatcctctaataaaatcaacccggatcgttctgatatctgatgatctgtagcaggcgcaattgcactttatattcatgtccagcttctgcggtatgatgttccatgtgctaatacaggtagctcaaaattgtttgtgtctgcattaactgaaaaaatatagacagcaagtttctgtcaccaaacaccatcaggatctccatatgaaaattacatagttgcaattacatatgccatccctcctgcttgtttatttcccatgctttcattttctctcttatacgtgttttatgtcgttggttatatggttcttttgacaccatttcaggtgcagcacaaactggagaaatccttcggccagaacagaaacagcatggggaacacaagatgattacagaagatcggctgcacaaagaccaattctagaaacagcatagaggccatttccagttcagacgactgtagtgctgtactgctgtgctgcacgtcgtacacgtcgaagtctgaagaggattgctgcactgcagatcaatcaatgattttccaattttcgtcaaaacaagaaaccaatgattttccaggctcatggacacggtctacccaggcacccatccgtagacggtaagcgatcctaatcatcactgtaggagtagcggggccctgtgtcttttgtcgtgctgcatatcatatcgtctatggaagaatacatgggccgtgtttagattcaaaatgttttcttggaacttccaacttttccgtcacattaaatgtttgcacacatacatgaagcattaaatatagacgaaaaaaaatcaattgcacagtttgcatgtaaatcgcgagacgaatcttttgagcctaactgcgcaatgatttgataatgtgatgctacaataaacatttgctaatgatggattaattagacttaataaatttgtctcgcagtttacatacagaacctataatttgttttgttattagtctatatttaatactttaaatgtattttaaatgtatggccgtatacttaaaaaaattttggaccacgaactaaacacaaccatgattaaaattagtctcgcctagcgtttcacacctgtccacttgcagtgcaaaattatgaaaaactgatggcgatctggcgatgaatgaatgaatgattcggaccgccgctacgttgttgctgccgacgcgttcgttggccgtgtgtccgtgtctcggtctgcagtcttcaggttcagaaagttttctccttgttctgaagtcttcagaggaaaattttgtttgttttttactccatcgtcccgtggattctgcaatttttttttataaaaaatgtaatttgttgtttcttcagtgtctcagtccgatcggaatgaaatggaatggaggagatggcggtgtgaactgtccttggtagtggagttgtggattggctcgtatacgacaaatgtatttggatatttggcacttgttatcgctggaaaaaatatagtcaagtcgtgtacgaggaaaactgcatgctactaccatacatacgaaggatatcaagttcttgacattttgatatggagcatagcaaaactgttctagttctcgtttgaaatgcgagaatgtgttcacaaaaggctgattcattttatttaaaattcacgcaatattcctctgttcgaaggaaaggtcttgttgtgtttttctttttcttttttttcttttctagtgcaggctgatctgctgtgctgagtgcagaccgtggcagaagtgatttacttttccttgtataagggggtgtttaaatccggggtgtaaagttttagcgtgtcacatcgaatattatataaggtatcgcatgtggcagggtttacattaccggttgaccactaaatttcgaaccccatcggtatcaccgttttcgataaattttgatcggttttcgataaatttcgaccaaatctattgtttatccttcgaaattccaatcgaaacttaattccgagccatgtaaacatcgaaatttcatggaatttgaccggtttttgtcggaattatgaaccctggcatgtggtgtttgggtactaataagaaaactaattacagaattcgtcagtaaagtgcgagacaaatttattaagcctaagtaatacatcattagcaaatgtttactgtagcactacattgttaaatcatggagcaattatgcttaaaagattcgtctcacaaattagtcgcaatacgtgcaattatttttttagcacatatttaatacttcatgcagatgtttaaacgtacgatgtgatagggtgaatatttttggggtgtgctctaaacgaggcctaagagcatcaccaacagattatctataattttctcctaaaaatttgatttttgggttttctaaactgaaaatagaaagtgaaaaaactcctctctccaacagatagcctaaattcaatccccaaaacttaaaagtgagcccttctgttaaactaccaaaagaaaattctgttttttttctttcacgcgcagaaagattgctatctcccacgcgcgggaatgaaggagagaggcgggattgcgtgattgggagtgactttcgcgcccgcatataaacggagcgaggaaccgggggaagggaactccaaaactcgggtaggagagtaggggatctgttggagctgatttttggactaaaatccctcaaaattagtttagatctaaactaattttgagggattttagtccaaaaatcagctccaacagatcccctactctcctacccgagttttggaggctgttggagctgatttttggactgaaatccctcaaaattagtttagatcccctaaactaattttgagggattttagtccaaaaaatcagctccaacagatcccctactctcctacccgagttttggagttcccttcccccggttcctcgctccgtttatatgcgggcgcgaaagtcactcccaatcacgcaatcccgcctctctccttcgttcccgcgcgtgggagttagcgatctttctgcgcgtgaaagaaaaaaacagaatttccttggtagtttaacagaagggctcacttttaagttttggggattgaatttaggctatctgttagagagaggagttttttcactttctattttcagtttagaaaacccaaaaatcaaatttttaggagaaaattataggttttttcactttctattttcagtttagaaaacccaaaaatcaaatttttaggagaaaattatagataatctgttggtgatgctctaggattctattctggaatcctttcgcttttatcggtttctcccaaaaagccggatcaatagcaattatagccgagtgcaggaccgtggcagaagtgatttctggtgcaccaacgggtgatgagccctgcagcccctgctcacatttgtagaatttttttcgtttttagatttttttttaatatttacagaaataatctatcggcgagaaaaattgcaaaaatagaccctgccgcccaccattggggcggcaagctgacgtggcagacggtgggtcgaccgcgccgtctgccgccgtcggccaaaattccgattaggcccttgccgcccatacagagggcggcaagggtctaatagcaattttggctgccctccaggagcttgcggctgtactttttgcatctgggtcccttgccagatgtaaaaagtacggccaaaatatttttctatgtaatgttaataaaaaataaagaagtatttgttggtaaaacttgttaatattgttataaaaatgtattgaagttggttgttgcgcaatttcatatgttaagtgaggtattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttcgattgcggttacatagatgatattagattcgaactaggagggaggtagtgtaatagttgaacacaacgacgatgtagtaatgggacaaggaagcatgacggtagaaattttaatttgccaagttgtccgataatagctaacccctacgtgaggatccctctcctctctcaaaccgcgctttagtaaccctgtattgctctggtagttcaagctgcacaacacggcaaggtggagttagaacccttctggtgtctatccattctctgtattgacatctccttggtggttcctgggaggaaagaatagatgtaaagcgagcaaagttagtaaatgttgtgagaaaataatgattaatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctttaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatttgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctgcgccagtttggatcctcaacaccccggcgtctagccattgacgaaagccggtaggatttgtaatgaagaagtggggaagagagtactgaatgtgactgagttctgaaagattgtgaggcctcactcgttaaggcgacttatatatgcgcaaaaaatcgagtgatatccttgacatgtgaacgtggtggggcatggcgggtacgactgattggcgccgaaagttgcacgcttgatcggcgccgaaagttacgttggtcgtatgcggcaaatggcgggcaaatactcgtagagcatgcgaataaaggaggctgcatcggtgcgggagaaagcaatcgtgcatgcgccgaaaggtatcgtgcatgcgccgaaagatatcgtgcacatataacaacaacgtagtcattacataagcatacagtactggaaagtcaagcaaataaacaaagagaagattgctctactggccctgccccgcgccgcgaccacgcttggtcctccgggcctgtgctcgcacgtggtcctgggagtaggtgaaacgatccggtggcacagcacgggtagcacgagtgtctggcggaggagtggcctgcgcctggtcctgcgtctgcaccggcggtgcgcctcccagctgtgaggggccgatgacgtcctctgccgagcctgaagcgaagtcgaagtcagtgatgtcgaagagcacggtggaagacagcaagcggtccgacgaggtcctagcatggtctagtggtggaccttgactcgacgtgccggctgcctgtgacgaagccccggtgtactgctggaactgcgctgagtgcgaggtcgacgcagctggctgagacgctgaccctgcagcgtgggagaagtaggcggcctgcgtcatagcgaactgggcgaaacctacacatcgacaacgggaccttgtaagctaagacataaaatacatgtaaattgattatcgaagtaatgttgttttttaagtacctatggggggcacacctgaaggcctagccgaggaaggtggggtgctgaacggtgcacgaaaccctgaatcaatcggcaagtgaaacggctcacatatatgtgcgaggcatgtacagaaaaatccttaaaaatacttacctccgtgcggagggggagtcggcctaggaacgtgcgcagctggacggggaccagtcggtacgggtggccgctgtacagctgcgtctgcccgagcaatgtcgtctgcacgacaggtgagcactcggagaatcgagcgcatcgactccaccatccgcgtgtacgtcgtcaggtgctcctctacgggtaccggaatccctgcgtctaaacgttggatcgtcgttgaaccgtcaacgacgacccggttgatgtcgtcgacctgcatggttaatttgttcatacatattcgtaacatttgacgatgagaaagacatgaaaacataaaggaatggtgcgatgcagggtactcacagcacgagcgaagtcctggtcgcggtgcctagcatagaggtctctagtgctcgcaacgtggggctgctgctccaagggagcgaaggtgaccctagtacgggtgtgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgacccttgcgtgagtacctacgaattaatgtgtaatattagtgtgaaacgacagatgttacaaattattgcaacaatggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgcggcactgtagggctcccacacgacgtcaatcggcagaaggcggtcgaactccataacaaactcaggatacgaccgcctaatctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtcgtgcacgagtcccttgtcgaccgcgtgcccgtgacggccacagaacatcacccagccaaaaagccagagcaagtacgcctccaaacatcggctgtaggagtactcgtcggcctccgcctgtagctgctcaacctgcaagcagtcgataaaatgttaggcaccttaactgcggactaaagatgtaatacgattgtcatttcggtaaaaaacactcacggtgaactgaagtagccacctcttcgtaggtccggtgttgcggtggtgtgccaacggctggagcgggaggtgcggtgcgcgctgtactagtgcgaaacgtgccgtcagttcgtcctgccagtctacagccgtggtcactggcccaacagcgtctcccgcgagcggtagccccaacaagcacgatacgtcctgtagggtaggggctacctcacctcacggcaagtgaaaagtgtgcgtctctggcctccatcggtcgaccaaagctgctaggagggacctgtccacagtccatcgtctggccgggtccgcatggccggcggcagcctccaccagccgacacatcggtaggaggccggcctcacgcagcctgcaataagaaattaatatgtcattacaaaaaatattacagcgcaactaatttatagtaatatactgttcgtacctctcgacgaaggagtcgtgaaccgtgagtagctcaccgcacgtccgtgcccggaacgtcccaagctgagccccctgcaccgcagtaaggtgagaccggtgtcggagatctatcgccgggtccaacagctgaggtgtatcctgacgtgccatctctgaaaaatatagtgtttcgtattagaacaattcaaaaagtagtaatgtaaaacaaaagatgactcgcaagttaatgaaatagtaaaaaaatcatgagaataattacgtacaacaagagtacagcctatttaaataaagcaaacgttactaatggtacataacgatgacgtgcaatttaacatatatgtagagttcgataatataacataacataacataatattacgtgtcgaagtccgacatacatcagcatacgtaaagacactaggtgccttagtctgacgttatatcacgagacctaaagacatgacaagccgaagtctgaaattacacgacgaaacataaacacatcgataagttcgaaacagattacaagcaaacccacatgccaacatagaacataagaactacaccacgtagccagacgtggcacgacgacgcctaggacgtggtcgagtggaggtagtgccttcacccgtagggcgagctccatctgctgctgatcctgatagtcatgcctccgccgcacttggtttctccttgtctttaggacaatgcttgtaggtgtgcccacgttcatcgcatttgctgcaacgcttcaccctgccagcctccgactcgtccatattgttgcagatgcgacgagtcctcctccttccagccttgcctcggagcttcgatgggtcaggaatattgagtacttcatcgttagtctctgtgaactccccagctatgccgaaccggtaaatctcgccgctccatgtatgatatattgcttgcttactgaagtactgcgacacatatactgcatctggtatgccacactccgctgcggcagcaatgacatgggtgcatggcctgtggagcagcttcggctttgaacaagagcaatgacatgtgccgtcggttttgagaacacactcctgcttcactctcttgcggtagatacccctgcctgccttatcttgacatagtatctcgaacctatgttgttgggtaccttgcactagagctcgatgtttcatggcctttttatgcaactcctctagctttttctgcatgaaagttccaaacaaaatgctgttgttcggcatagagggaagaattgcctggaaccgatccctaaaatacctgtatgtcccatgtaaaatgaactccactatgccaactagtggcagtccacggacaccgcgcatcacccagttgtaaacttctgccaaatttgttgtcattattccatatctagcaccaccggtgtcatacgccttggcccatttctcttttggttcatgcagaatccactgagaaaatttccgaatctccaatccagttcttctaaccaaagttggactatccgttggaagaggtccaagagcttgaggagggtcatcaacggcagtcgatggagccgctgcacgctgatcactgcatttggctgtcaactcatctaatctcttccaaagctcattgaattttttctcctggttctgattgcacagcctcctgaacatgttcacgagctccttgttcttgaattgcttgaagaaattagctcccatatgacgcatgcaccacctactctgtacatcgtcccaaacaccagggtatcctcgttccatgctcccaaactgcaactcttctatcgttcgcagaatgccagcgtgcctatcatgtatcaggcacacatttggcctcatactaacaacttttgttttaaccaatttcaggaaccagtaccagctgtcggtattctcactctcaacaaaagcaaatgccaagggaaatacctgattgttcccatttacccctattgctgtcagtatctggccccgatactttcctgtcaagaatgtcccatcaatgcagataactggacgacagttcacgaatgccatcttgcatgcatgtagagctaagaacgccctttgcagcacactcttgccaggatgttcaattgatgggaatttcttcacttcgtaagagctcccagggtttctttcctcgataacaccaagcaggcgtggcaaattgtcatacgagacttcgtatgttccaaatctcatctctattattttctgtttggccctccaggccttggcatagctaatagtatacttgtatgtctcctcgatgtgtcggattattgaccttggttcgtatgtgagattatcgatgacatgcgcatacatctcagatgcgacaaatgcacatgtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttggacttggcagcccaaaactctctatgaagtgacactgcaaaatgctttaccgcctccttcatatcttctgttctactataaatcgctccctgaataacctcattttctttgtattcccatctcacactatcctcttcagagacgatcagcccagaaaaatcctgactagcccattctgctggattaatatccgtctcctcatctgacgaatcaccttcctctacacgcccgttgtcagaatcctccctctccatttcatccacaatggctgcgacagtctccccctcgtcggccactccacctggttgaatgcccactggagctactacgcccccgtccactcctgcgttgacctcctccacagaagtctcatttacttcagcgcttggtccctcgctatcatccatgttcatctgcacacctggatccttcgggtgcacaaacggaaccaaagctagaggccacccacgttgcattgcattttccacataccatctccacacttgggagttttgaactggcattagttcccaattgcccgacttactataacattgattgttatgtcacttgtctgtggatcaactctcaaacccctcattaaccatccttttatagaaggtacactcctctcagccggtctctcaattcccctttctgatacaataaaatctgacagatctaccccagttggcccgtaacggacgtttcctggtccatggtaaacttgaaatattggtttgttcgacatatctgtcaacgaattaactagatcatattactctttcatgcaataaacatctacaacgtaatatcttcttgtgtaagccaatgcaacggtaaaatattgattccaaactagcagatctacgttgttaccgatatctacaatacgcacttctaaattagtacaactaaaaccataaaaatataatgcatttattcaaataaattttttaaaaatacacactatttaactcaatagtcacatataggatctacgaatattacctgaaatcggcgtctgaatccggcagggcttcgccccttcttctcttctcctcccctctcttctttttttttcactggatttgagaggtgaggaatgagggctgggggctgggtggcaggccttttataggcagcgaggcctgccgcccggccagagggcggcaaggggccgcctgcaaaatggccggccccctgccgctcttttgcattcggaccccttgccgccccaccagagagcggcaagggttttcatgcaaaaaacccaccctccgtcaacgcccgttcctcccccgtttgtcacgtcagcttgccgcccaccattggggcggcagggtctatttttgcaatttttctcgccgatagattatttctgtaaatattaaaaaaaatctaaaaaggaaaaaaattccgcatttgtacggatcctctcccggcccaaatggcccaaacaaatccgatccagccagcagcccgaggcccatgttggaggcccggtcgatctcctacaggcgatctgaagaaccatctcctcaccatcctcgccggccaaactgcggcctccaacacgcgccggcgggcggaggctcgcggcagatgcgcccggcaggtcaggccgccgccgtagcccgtagatagggtgcgcgcaggacggagctgttcgtggaggccgtggggtatgcgctcttgaggtaaatcaaagcttcttggttgattctcctgtctttgtttagggattgggacgtggctgcaaaaactttggttgagatttctggcatttctcgatgcggattagcggcccactcgttgtaaatcacacatgaaaaatattcgaaattgtttagggattggggcgtggcagcaaaaactttggtagccactaattaatacaagaacattttgcattcacgtatgattgtaagacgatgcatttactaacagatttcagtttacttcagtcctccccgcaaaaaaataaaaaataaaaaataaaaaagagagagagtttaattctcagtgttgtaaactcatagtagaaggagcatcatttgattagcacactttgttttgtgtggtaaattaacatcttgcatcttatatattgtggatcaggccatataacttatttcttttttgcaatatgtatgacttgaaaatgcttgttttctttttgcataattgatgctagctaatttggagaatttgatctctcaatatggatatgtttacagctatatttagctgatattatgttgatgtacattttggctttctgctaacaagttgtgtactatttccagtccaaagagagatctttttttttttttttttttggggcaaagagagatctctttaacaagctaagttttgtataactgtgtgagtggagctaaaatgataatataaagctttgattgggatgtgaaaatccatgggtggactcaggtgcatggggtctatcaagaatttagataattattgttagcaaacatgttttaagtgttcctctgctttgtccagtacctttgtgtattgtcacattgctattagctttaggagcaagataagggctaaagatcaaataggttccagcaatgccaaatatttcaccatgttacaaacaccaatattggttaaagtttctaagtattttggtttgttccatttggtttttggcagcttcagtatggtttttgtgagctaactttttattgaaaattttgctttgcattgcccagatgtctaatctatcagagccctcaaaagaagctgtgtcagctgacgattcaagtgctgtccagaaaactggagcatggagtaacacgttgaacattcttctgcaacaaacttcagtctatggtgtggctgctggttattgcctgtcagcatctctgctctccattatcaacaaatgggcagtcatgaaatttccttaccctggagcattgacagctttacagtacttcactagtgttgttggagttctcttatgtggacaactaaagcttattgagcatgatggccttaatttgaggaccatgtggaagttcttgcctgctgctgtgatgttctacatctccatcttcacaaacagtgaacttctactccatgccaatgtggacactttcatcgtgtttcgctctgctgtgccaatttttgtggccattggagagaccttttatcttcaccaaccatggccatcactcaagacatggctttcgctttcaactatacttggtggaagtgtgatctatgttttcacagacaaccagttcactgtgactgcttacacttgggcagtggcatatcttgcaagcatgtccattgactttgtctacatcaagcacgttgtcatgaccattggcctgaacacatggggccttgtgctttacaacaatctggaagctttcatgctcttccctcttgagatgcttctaacgggggagcttaatcagatgaagggcgacaatgctaaagtgacaaactggctttcatctgatgtcattcttcctgttgctctgtcgtgcttgttcgggctatctatatccttcttcgggttctcctgcagacgggctatctcggcaactggatttaccgtgctcggtatagtgaacaagctcctgactgttgtgattaatctccttatctgggacaagcatgcctcctttgtgggaacaattgggctcttgatctgcatgtccggtagtgttctctaccagcagtccaccacaaaaccaaaggcccccaaggctgagccaaaagaggagaatgatgaggagcagcagaagttgctggagatgcagcaagggcatgaaagcagctcaactcagaagcaaacatcatcttaagcctggtagaaaatttggcattgatatcttaagacagcttccctgaaccatttgggatgcttgggaaggatcatttggccaaaggatattcattcgttatatgagaaccttgaaatgccgttggcatgaaaaatcgcagagaaaacttaatgtcactttgcaattctttgtttagtagtataccgtatttatttgttagacctgtggtagggtatcaattatcaaagaatcccgaaacatagtcgaactggattcttcgtatacaatgtgctgtttcattgataatacagggtggttacccatttctatacaggacgcgcccggcagggcaggccgcaggcgatagcgtcggcgtgcaggaaacgagggtcacgtaccctgagtctcggactccgtgaggctgtgggctatatatgctcttgaggtaaaaccaaagctgcttggttgattatccagtcttgtttagggattgggatgtcgctgcgaaaaaaatggtaagatttatggtgtttctggatgcggtattgcagtctcggttgcagattagcggcccgctcgtggtaaattgcagatagtagtagtatttatttgagaataatacaagaagtcaagaacaatttgcattcacgtataattgcgacaagattcatgtacttagtatcagatttcagtacacttcagtcccttccaattttctactgtttggagcagactgtatctaactgaatttcactaccagataacagagctggacaatcgaggtatttgggtttgcctgcggtgttcatcttgctggtgatggagccactgaatcagccttgctagagtaagaaccacatagagatcactacctattgcttatctaggaaccagcatgtgcacggtacgcattgttgattgacttggtcataactagtttagccaaaatatttgtacatgattatctgatcatatagcacacctactccaaagaacacaccaaatgcaattgcaaacactaccttgtcgatatactgctttgtcaagatagtggaggttggagctgcttctgctgaattgcagtggtgtacaagcatagggctgcatagctttgggtttccagcaaaactagaacttggaaatgtgctgaactggtctccgcttggtacaggccctttaaggtcattgtaggaaacgttgaattcggaaaggaagtgaaggttcaccattgctggagggattgcacctgtcagatggttgtatgacaggtctagaaccatcaggttcttgaggttgctgatcgattctgggatctctccatttaagttgttgaagctcaagttgagtgaaacaagttcttttaactcaccaatctccatggggatcacaccagtgaaattgttgttacctagattcaacatttcagggagagcagtagttgtatgatactgcaaacacaaacatgcacccgcataaaacgaaaatgtaaatgctctttgttctgagttatctgcaaccttgtctgactttagcattggcatctccattagtgccgctggtatttctcctgtaaggctattattggatacatccacatacttaaggaagttaaggctattgatccaggtcggtattggtccactgagttgattgctgtataaagttaaaacctgcaaatttctgagttttgataaccaattaggtatcttaccatacagtgcacaacgctctatggcaagaccctgaatattctcaaaaccatcaattgcttcatcctgtggcatagcttcattcttgaagttgctccccataaacaagacagtgaggttccttaagctcttgagtatgtgaagggtattagttatgtttgtaaaattgttgtaggaaatagataagaaggtgatcgacttaagatttcctatattttttgacaactggccatgaagcctattggcagataggcgcaaccaagtcaaattgctgcatgagtagatgctctctggaatggtgccgttgaaattattccaggaaaaatctaatgctttcagattgggcaggttggagaagttaactttggcaagctctcctgtgaacttgttggtgctgaggttgatgattactagatttgtgcagtcgcccaaggatgctggaagctctccagataagttgttgctgctaatgtgaagctcctttagtctctttagctgaccaatagaatttgggattttgccactgaatctgttccagccaagatcaacaaaaacaagattactgagctttatgatgagtgaaccattaattgttccttgcaaaccgttgttagcaaaagagaggtactccaatgatgtggcatggaagagatcatccgggagggccccgctaatgttgttgttaccagcttttagcattctaagggcagtgcagttacctattcctggggggatgctgccactgaactgattgtagccaatgtcaataacagcaaaagatggcgagccgatgcagaaagaggaaggtatatgcccagtaaaactgttgttgctcacgttgattgcaaccaggttgctcattttctcccatgtgctggagggaaatgctcctgtaaactggttgcttgagatattcagtacctgcagtggctggttagatactgatgaattcagctcttgcaggttgccgttgaggtggttgaagctgacatcaaggacaacgatgctaccagaggacatcagctctgccggaaggccaccggagagcgagttgtacgacaagttgaggcgcgacaagctggtgagctctcccagcgacggtgagatcctcccttcaaggcctttagaggcaagagagacctcaatgacagccccatcttcactgcaggtgatgccttcccactcgcagcagtccatgccattccgccatgacatggcgatgccattgtcgtgtgatagcccagcaaggaaccggaggagagagctcttctcctgctcgaggcacgcaatggtggagacggccatggggagcaggaacagcagcagacataacgaggaagcagcgaggccagagaaaggcatcactaccctgcttctccacgcagaatggggtgccatcttcatggtctctcttatcacaggtctttggagttgaatttggcagctaatgttcgcgaaaattacattgttcgttgagcatatatgtacacaactgaatgcatatattatgtacttaactgaattattgtttcgtttgaagtccggagatattgattttgtgttcgcagccataggacttgtgagccatactgctacctgtcataccatttttattttctgtgcagccttactttgtcaactagagcatgtgatcctacctctgtgtggtccaagttgaatgtacagtttcttcttgataagtacattgcagaggtttcattctccctagtgtcggttgttctttctaagtagtattttgttgtctcttgtggagaatttcaacaaagtttgtgaaaatgttttatgttgcaaagacaggtctggtttctctcattggtcgatcccagattacctcagtaatatgaagttgtgcattaattttgccttccagaacacgtccgcttgggtagcaattcatgtttgctatgtacattgcaaaatttcatccattgtggcaagattgaattggtgctaagattaacctggcatttttcattgatcttgttcacttgtgcagttatgagacttttggttctgactatcatgttcttggttgttcagttggtctgtcacatgaactggacggtcggaatttgaatattgatatacttcaagcctgtagtcattttagattttttttttccgcagattgttaacgcatttggatgaatttcatgcaaaatgacatgtttgttgcacttcgtgcaaacagcacgctcatcagaaattctgaataaattaactatcaaatgctggtcaggatcactgatcatatttacttccagataggactaatcatgtacttcctctgtcccatagaaaactcagtcctagatttaaatctagatatagtttagattcaaacccaatcctaaatttaaatctgcacaatcacaatgagtcgtttgcaataaataagagttcagacaaaggaacgaatacacacgaatccaaattattttcaaggaggagaatgataatgtcagtcaaataagctgctgttagacattgaatgccgcttgaaatgatggatggattggccccaaactttgataacggaggggaaaaaattttctgacctttgacaggctagtgtcgcgaagcagcctcttggtccaggggcccatggcaacgacgacgccattaacaaacctgagaatgtagatcgaccgagtcaagatcagcagctccatagtttcttttattcttatacttattcgtaccacctattaacaacctaaaaataatttataaataaaacttttataaacatgtttttaacgttaaaaaaatgttgtaaaataaaatactatggaaaaaactacaaaatcaacttcaaaattaaactttaaaatttaaaatttggtttaaaaacttaagtataagagaaacaagggccgcaggtcactaactatttaagctaaaatagttggtcaagactaaactggtcatacatcactcatattccaaagaccgaaggcggcggtcagagatgaatttatgatatacttatttctcttattcgctccatctttaatcttatcttactataactactagcaatttaatgttcactaacttctaaaactcaacgtataagagcaaggctaataatacagccgacctgttagctataaggttttttatagccttctcttagcctacccatataatagttagcttataatcaatatagggctcacttgtctccctcacagaatttcttggttcttatgtctaaaccggctgtaagtttacagcccgattctcctctctctcctcttttttctccttcaccttagcatttagccggcttatagcctactattatacttgctctaagtattcacatcatcattcactaacaattattatttagagtattttaaattacatgcaaatgtaccacatcatcacccactagcaattattatgtagagtattttaaatatcatgcaaacaatgctatatcatttataattttgttgtatttttagaactcaatatgcaagcaatgtcaaatcattattttcacatcatttaaatatacacatctatcatttttataatgtataacatacatttatccacatatttcgtagcagagcgcgaggtatcatctactcccttcattccaaaatataaggcacaaccatccttaacccaaagaccaagaaataattattatcacctctttctttgaatcatcccaactaatataacacatgcacccaatagaattaaacatcttgtgattataggatttaaaaaataatagtttaggagagaggaggtgctattaattgtcatgcatgcatgcacgtcttatattatgaaacacctttaaaaagtagttgtgccctatattttgaaacgaatggagtagcttaatagcagtatcttctcatcatctttgatgatattatttaacttatcaaatatgacatactatattatatattcatggtagcttataactcgcttcaaataacaaaaatgtcccctattattaacctttttgttagtaaattgtattttgcaccggataaatgtgtcgcgtttcgctttacaccaggttttgcatgtagtttagcacatactttttcacttagcatcaagttatattgaaataagtttcacttaacaccaagatataccaacaaacctattaaaatttcatgaaagctcataaagttcttaaggaaacgttgtgaaacattgtataaattgaagaagtttcaaaagttttacttatattttacaagattttcttttagttatatgacgcaacctagtgcaaagtttgcaaagttgtagcgtgaaagtaggtgctaaacataaagctacgtaaaaagttttttaaaaaatgtaaattcatgtgtaaagcgcaatttatttttcttaactacgaaggcttcttacactgagccatggcagcagaactgatttctggtccagtaataggtgatgatgggctggctatgctggactagaaatcatcaattcaggacatgaagccgaaccgccatttctggtgtggtgatgaagattctactcatcggggttcaaaaatcatgatgcccataatattattatgcacatgtaggtgtgctttcaacaggattttagtaagatcatgaatgtgctgttggtttttgtctcttagagcatatgttaggggacacattcgcagggatgtgagtgatgttgcgtgcttagtggtgtgtgcgcgcgtgtgtgattgctgtgatatctaaaaaaaccgccatttgttatgcaaacatgccacgtggactccatattagctaaaaccatcatttaaatagctaagggcttgatttacactagttttaaaagttgagagtgttattaaatactccctccgtcccataatataagggattttgagtttttgtttgcaacgtttgaccactcgtcttattcaaaattttttgaaattattatttattttatttgtgacttactttattatctactgtactttaaacacaacatttcattttttatatttgcaaaaaaaaaattgaataagatgaatggtcaaacgttgcaaacaaaaactcaaaatctcttatattatgcaacggagggagtatatatctggttttgtggttaagggacttaaatgaaactcgacctctgatgaaggaaccaatggtgaactttttcctgagctgtgtgctcccggcccaaacggctggacatgaagcccgtatggcccaaacaaattagcccaagtcagcatcgcacaccaaaaaaaaaaaaaaaagtcccaccgccggcggcggcggcggcggacgagcccggcagcggcagggcaggccacaggcgatatggtcggcgaggctcacatcccgtgactacatggaggccgtgggctatgctcttgaggtaaatcaaagctgcctggctgattgattctccagtttcgtttagagattggcaccgtggttgcaaaattttggttgagatttatggcatttctcgatgcggtattgcagtgtcattggttgcggattagcggaccgctcgtggtaagtagcagataaattattcgaaatatagtcacaaattagtacaagaacatttctgtaagaataatacaagaacaatttggatgtattcattgtatgtataatcgtgacatgaataatttaccagcagatctcagttcagtcagccccttccaattgtaatttttggagcagactgtattaactgaacttttaactaccagatcacgagctggtcagtcggaggattcatcttgctggggttggagccactgaatcaagccttgctttttgccgggtcggccgaaggaacggcgaccaaatttcattaaggaattgggggaagaacaaaaaaaaattacagatagattaggcttacaatcgaaggaatcaagccttgctgaaatgagaaccaattgaggttactacccatttcttatctatgaaccagcacagcacacattatttattgacttgatcataactggtttagccaaaatatctgggcattattagctgatcatatagcacacctactccaaagaatacaccaaatgcaattgcaaagacaacctggtcgatatactgctttcttgaggtaggggaagttggagctgcttctgccaaattgcaatggtgtacaagcatagggctacatagctttgggttcccagcaaaactagaacttggaaatgtgctgaactggcctccaattggtacaggcccttcaaggtcattgtaggaaatgttgaattcagaaaggaagtgaaggctcaccagtgctgatgggattgcacctgtaagatggttgtatgacaggtctagaaccatcagatttctgaggttggtcaccaattgtgggatttccccgtttaggttgttgaagctcaagttgagtgaaacgagtgcttttaactcaccaatctccatggggatggcaccagttaatttgttgttacctagattcaacattttagggaaagcggtaattgtacggtactgaaaacacatacaacctacataaactggaaactgaaagagtcttgggtctgtgtaatctgcaatcttgtctgattttagcattggcatctccgttagtgctgccggtatttctcctgaaaggctattattggatatgtctacatacttgaggaagtttaggctattgatccaggttggtataggtccactgagttgattgttgtataaaactaaaacctgcaaatttctgagctttgagaaccaattaggtacttttccagacagtgcacagtcgtttatcccaagacctagaatattcttgaaaccatcaattttttcatcctgtggcatagcttcattcttgaagttgctccccataaacaagacactgaggttccttaagctcttgagtatgtgaagggtattagttatgtttgtaaaattgttgtaggaaatagataagaatatgatagacttcagatttcctatattctttgtcagctggccatgaagcctattggcagataggcgcaacgaagtcaaattgctgcatgagtagatgctctctggaatggtgccggtgaaatcattcccggaaaaatctaatgctttcagattgggcaggttggagaagttaacattggcaagctctcctgtgaacttgttgctgctgaggttgatggttactagatatgtgcactcgcccaaggatgacggcagctctccagataagttgttgctgctcatgtgaagctcctctagcctctttagctggccaatagaatttgggatcttgccactggatctattccagccaagatcaacaaaaacaagattactgagctttattatgagtgcaccattaattgttccttgcaaaccattgttagcaaaggagaggtactccaatgaagtggcactgaagagatcatctggcagggtcccaatgatgttgttgtgaccagcctttagcattctaagggaacagcatttacctatcccatgggggatgttgccactgaattggttgtaagaaagatcaagcatagcaaaggatgatgagctgatacaaaaagtggaaggtatgtagccagtaaaactgttgttgctcgcattgattgcaaacaggttgctcattttctcccatgtggtggacggaaatgctcccgtaaacaggttgctcgagatattcagtacctggagaggccggtcaggtgatgacgaattcagctcatgtagttctccatctaggcggttgaagctgacatcaaggacgacgatgctgctagtggatatcagctctgatggaagcccatcggagagcaagttgtacgacaggttgagtcgcgacaagctggtaagctcgctcagggatgatgagatgcacccttgtaggcctcttgaggccagtaatagctcagttactgcaccatcttctccacagattatcccttcccaggtgcaacaatttggactattctgccatgacacggcgaggccaccatcttgtgataacccagcgaggaaccggaggagggaatgtctctcctgcttggtgcatgaatcaacaggagagatgaaagtcagcagcagcaacacaagagcaggatcaaagaaatttatgcaaaaccttctggttttgttgctgcgccaagactgcggcttcatggtttgtatcttttggaagctgtgacagaatagtgagcttgatatacctaggtaggctggtattgtgtgcaaaaccacagttcctgagctatattggcaaagcatcgaagagttataagctgatggagtgttgacctatgagtttagttgcttctacctcactggcttggtactgtgcttaggtttgggaattccgtctttctgttttcttttcccaatcttatgtattggttcatgaagcttgacaggagtgcttccacttaaggccttgttcagtttagaagggattaaatggggttggagaggattgagggagaataattccacaccacaataggtgtggaataaatcccttcaatctctccctcatggggatcaactgaacatgccctaaatcggatttttcctcttacagttaccacttgactactatttgttaattttttgccgggttactatttgttaaattctccattcgtttagtcctaaagcagagtcatagtccaggtctatgccctctagtgatttccttattcttttttttcctagatggaggtatggcgtacaggcgtacagccgagcaccgtgcttctaatctcagtaattccagcagctgcatttgagtcctttgtcaacaatggatttgtgactgttgactgttcttggcttgcgataatcttttacagcaatcaaaagattgacctcagttggttacattacctcttctttttctttttatcttgaaacggtttggctacactactaaaacagtaattgatgcaggtatagtacatgattgtgtgctgctggaatgcttttgcttttgcatggctgaacaaagtttgctcaaggcttcaagtttcaagtaaaggttgtgttgtaagcctgtacagcggtagtgctatctaatagtagtctattgttctcatttccttttcagttcatgaccctcgttgttctatacaaaatttcaacaaagtctgtgaaatttctttcacagacagttcttacatttgcatattcagacggtctgatattatcttagatcgtgtcagctctcataatgagcttgtatattatatcttggtgcttagtttcggactgctacctaaaggtaactatatattttgggacggagctattaattttctttttcagcagcttgttggtacatttggatgaattctgcgcaagatgacatgcttgttgtactttgtgcaatagcatgctcatcagaaattgagaataagatgccttatcaaatgctgatcaggatatcaccagggtttaccaaatcgtgcggttatcgctgacggagctcgtggctcctcaccgggagaccgcgcaggcccccctttgccagttcggccgggggcttagggtgagatcccaagctctctctctctctctgtatgtggaaagatcgtctgttcgcaagagaactcgagacacggcgatgtatacaggttcgggccgccgcgaagcgtaataccctactcctgtgtttttgtggatttgtgtatggatgagctacaaagtgtgagccgacttctcccccgctctaggctctaaatctggcaagaatcaaccccccccccttctctatgggcaaggtcctccttttatacttcaaggggataccacatgcacccttccctttccaaactggactgttctttttctcttgaacgggcggagatcagcacggttgctgtccgaatgacgctccgatgggacagcccacacctacctccacttccgccgggggcaggtgcgtcgtgggaacgtggttgcgagctgacgacatgagcagtgtcaaaccggtcacaaatcggtcattcttgtccgccgcgtgtcagcttagcagtgtgcatgtttgcccttcttcgtgtaacaccttgcctgtaatggttaggatgaagcctggcataaatctaaccagggctaacgtgccatctctaagagataacacgctagctccggcttgagacgagttgcctagaggctttcgtcttgacgggatggggcaaggcgtgtgtcagaccgccagtcgccacctaacccttgatctgaccggtctgtgactggtcacagaccggataaaagagcgtgctgcactgcgttgcacgcagcgtaacacgcttgaccagactgcaataaatgctgttaggtgagcacagctgtgctcacttatcccatatatatggcgcagacttctttaaggggtcggggtgcctcggccctcggggccggggcaagcgcaacccgaccccccctcgggggaaatcacgaggagggcggacacctcaccctcgggcccaatcgtccccgaaggtgccaggccacgtgggcgattgcgtctgcctcaagcctctggtcatgatactcccggtcccatatcaccgacagtagcccccggcgttacgccagagcaattttcccttcccaagggaagcggtcaggtgtgacgccaccattaaagcctggtgacaggtgggaccggtctccgtagttgggcaaaatgcccaacggtctcaatccatgcacattggtattgataactttggttatccataatgggcggtctattcaagactgccacaccacttgagcagcgcgcgaatctgggcgagcagatttgtctcgctcggagatacggtaacgccgcttcggtcggcgagcgtaattaacgcgcgcacgatacgatccgtttcgattgccacaaccgcatatccacttcacgcgccgtaagcgggcgaatgggattagtggaagcgtgggcacgggaaacgagggagcgagatagcgagatacgagggagcgaagtagtgggcgcgagaaacgaggagccaggcccagcgatagcaagggtataaaagcatcgagaaaaggatttgctcccttcctttcgccattgttcctcttgccttcgccgcctgagctctaactctttctctgctacgccctactttcgccacacacgctcgttcccaatcatctcttcctccaccgccatggcacggggctctgctctgctcgacggcagtgtactgccgccttcccgcatcgtgaatgagaggcacgccggactgccgcgccgcttcatgccggagtccgctaccggtcgggagatagtgatgttgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacactggccatcttcgcgcacctgtgcgagatgttcattggggtgcgcccctctcttcagctgttccggtggttcttcaccgtgcagtcggtgtcgccgccgtcggtggttggcggctgctacttccagccgcgggggccggtgctgaaccgctacatcccctgcgtcctccgcaagaagtgggacgactggaagagcgactggttctacacccccctcgccgacgaagcgcgcctccgccttccaagccagcccccggcgcaggtctccagctggcgggcgccggcagatctgggggaggagtacgacgccgtcctcgaccgtctagcgggcctgcgatcccaggggctcaccggggccatggtgtacggcgattacctccgtcgccggattgcgccgctccaacggcgcgcccggagcgcctgggagtacaccgggccagaagattacatgcggacccaccagggagccagatgggattgggctcccgaggacttcaagatcgtggtccaaagggtgctaaatcttagctccgcggaggcgtctcgccttcctcaggagatcctccccctctgcaccgaccccgaccgcgtctccattctctccattatgttgggggtcggggcctcagaggagagagcccctaagggccacgacggcgcgggcgagcgccgccgggggaaacagtctgccccaggagggggtcgtgcttctgggcctcgcgtcgggggcccggggagcagccgccctgccgacgcccaggggaagaggaagctgggaggaacgcctcccccatctcctccccgagggggcggggcggcgcgtgccagcaatcggcgcccggagggggccgcgctgacgtcgcaacccgagggggagcgcaagaagaagcggctccgcaaaatgggggagacggaaccagcccggggaaacctaatttcccccccaaggtggtcattcacccgaccccctcgcaggttcgtctcactctcattgcatccacctttctcaaaaaagaagttttttcttgctcactttgttcgtcttctggttttttattctgcttcagcgatgtcccatcgcactcctcccgccaccccaagtctggccagtccgaggccgaagatgcggcggccgcagaagagcggaggcgagaagctgaccggcgtgaagccgcagcccgccttcgggaagctgaagaggccgcccgggaggccgcccgggttcgccaagcagaggaagctgctcgggaggaggccgcccgggcccgccaagccgaagaagctgcccgggaggaggccgcccgggctcgccaggctgaggcggcagcgtcacttgggcccactccctcgggcggccctcaggcgacatcctccgaggcggcccgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggcttttctcctcctcttccatcgccccggtgagcgctgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggcccaccgtcgccacatctcggagcttgaagcccgcaaggcggcgctggcggagatcgcccgagaggtggaggaggagcgagaggccgccctcgtcgccaccaccgcgatggtcgaggcgcaagacagcctccgccttcaacacgcaagctgggaggcggagctgaagaacaagctcgacgccgcccaaggggttctcgactccgccgctgcccgagagcggcgggcaacggaggccgaagcggcgtcccggcggcgcgaggaggcccttgaggcccgtgccatggcgctggaagaacacgccggcactgtggagaaaggcttctcggaccgcgaggccgccattgctctccgggagacgacgctggcggcgcacgaggccgtctgcgccgaggaggagtccgcgctccgccttcgcgaggatgcactcgctgagcgggagcgagctctcgaggaggccgaggccacgacgcaacggctggcggacagcctctccctccgcgaggcggcgcaagaggagcaggcgcgccgcaacctcgaatgcgtccgcgccgagagagccgcgctggagcagcgggctgctgacctcgaggcgcgggagaaggagctagacgcgagggcgcctaccggcggggcggccgcgggcgaaaacgacttagtcgcccgcctcgcagctgccgaacacaccgtcgcggagatgcagcgagcgctggactcctccaccggggaggccgaggcccttcgcttggcgggcgagattgggcccgacatgctttgggatgcggtctcccgcatgaagcgcgccggtcggcaagcgggcctctgggggggccagacgtcggtgccccccaccaatctagaaggcctcgccccgcacctcaacaggatggcttgggttctcgagcaactccccgaggagcttgagaagaccatcaaggcatcctcgagggacctcgcccggggggcggtcgaactcgtgctggcgagttaccaggcccgggaccccaacttctccccctggatggcgctggaggagttccctcccgggaccgaggacgacgcgcgcgcgcgggtcggagatgccgccgaccacatcgtcaacggcttcgagggctcggctcctcggctcgcgttcgcccccggctccgacgaggagggcgacgccagcggcgaggacgatggtggcgacgaggccggcgacccgggcgcatttgaatgagcccccaggcccccgccaatcttaacttttttctttttctttcttctaaggccttcatgccttttttgtataaatcaacttaatctgcaatgagaaatgatgaaaaaatttttgtgttagttttattttgctatatatatgagttgaggatgatctgtgccatggtccttttgcgccttagcttgaaataagggctcgcgcccaagtgccggtcctcgaatggctcgggtcggggctagtgcctggggagatccacatgtcaagactggccaggccgggaacgtggtgaccgaggggtatgggtgacccgattgtgggtttttgccggttcccccccggagttcaccacgccccggggcacggctcggttctgggccccgtttggcgattttagctggccgaaccgagcccccgagggcggggttgagcatgagtgacattatttcaagtccagattcttcaaaaggaaaaaacagcacagacacaacctttaggaaattgaaactgcttttattgaaatgctgaaaggaatatatgtgcatgtgtggtagcccccggctaacccggcacacccaaggggggtgcggggttagcccgagccaaaacctgacacccgaccccccccttcaggggtagaagcgacgaaggtgttcaatattccacgggtttggcagctccgtgccgtcgcccgtggccagccgtacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaagctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagtttgatgcccatgtcttcgcagtagtcgccgaagagttcactagtgaattgggcgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtctgaatggtcccaggatatcaagcccccagacagcaaatggccatgacagtggtatgatctgcagggcctgggccggctgatggatttgcttggcgtggaactgacacgctctgcatcgccggaccagatcgactgcgtcattgagagctgtcggccaataaaatccttgacgaaaggccttgccgaccagggtgcgcgaggcagaatgggctccgcactcgccctcatggatgtcagcaagaagctcaacgccttgttcctgaggaatgcacttcaggaggattccgttagccgcgcgccgatagagggtcccttctaccagcacgtaacgtttggaaacgcgttgtacacgttcactcccttcgcggtcctcaggtagagtcttatctgtgaggtatgtttggatctcagagatccaagcaaccaatctaagggagcttggagcgcttccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcagccatgttatcccttctgggtacatgccgaagttctatcccatcgaaatggcgctccatacgccgcacttggcgtacgtaggcgtccatctgtgggtcagagcaccggtactccttacagacctggttaacgactagctgggagtcgcctaataccaaaaggcggcggatccccagtccagctgccactctgagtccggcaaggagtccctcgtactctgccatattgttagtcgctcgaaagtcgagacggactaagtatctgaggacgtctccgtttggagaggtcaacgtgacccctgcaccggcgccctggagagacagagaaccgtcgaactgcatcacccagtgggcggtttgaagcagctgagaggggttcatactggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttctctaggggccgtacccccggggcattcttcgtccaagtggcccctcggggcgcactcgtcttctgtgccgatgacctcggggtcggaggacgacaggagcggccttcccacagtggcctcggggccgtcctgggggtcgggggctcctggcatcgtcggacaagcgggcaaagggccaactccggtcgtcaggggcctctggcctccgttcggctcgggggcctcttctccccgctttttcccgggccaagtcggcacagggttagcctcggggtcaaagggcgttaagtgcggccttcccgcagtggcctcggggccctcctgagggtcgggggcacccatcaccgtctgacaagcgggcagagggccgactccggtcgtcgggggccttcggccgccgttcgactcgggggcctctcctccctgcctgctcccgggccaagttagcacagaatggggatgcgccgaatgaggattgtcctcatcgcgctccacaaccaacgctgcactaactacttggggggtcgctgctaggtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccagtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatacgcctcaacattacgtcctatttggctacccaaagaaattcgagtagtacgctgaaaagtaggacctgcattttttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcaggggataaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcacccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggtggcgggggcagaggggccaagcctctcgtcaccaccctcgggcttggacgcagcagcgaggcggtccgcgcgctgctccatacaagcgagcgcgactttaaggtcgccacggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaacggccatgtgtgccccggcgtcacaccgatgattggttgagacggctggagctccatccccggggccttgatagcatcaaaggccgcgggagaaaggatgttgagggccgctcctccatctatgaggacacgtcccaacttcacgttgcagatggtgggggaaaccaccatcgcaacctgccctccctgggcaatgcacggtgggtggtcggtctggtcgaaagtgagagcgacctccgaccaccgcgcccgacgcatcgcctcatgagtaggggccatggccagaagctctcgcttcatagccttgaagctccggcgagagacgtgagcacacgctcctccatcaacggtggcaatggtggccccaggttcttggaaacctaggtcatcatcaccatcgtcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccacgagatcgtggagggaggtgttgtgaacggagcaccacctgccggcggggcgctccctgccgggagtaccagcctctttctttttgtcgctcgcaggcctcccctttcgggtggcccgcggagcgccctcgacggcgaggacatgaccctcgtcgccggaacgatccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaggcaatcttttcgagcatgcggttgtgccgcacgccccccctgaacgcgtagatcaccgcgtgtgcagggatgcatggtatggtattgcggacttggcaaaaccgctgaatgtacgagcgaagcgactcatcatcgcctcgctgtactgcatgcaagtccgcttcttcgcctgggcgcggatatgtgccttggaagttcatggtgaactgctggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcagtggggttgacactcccatcgtacttctcggtgatggtgggccggaaccttgggggccaacggacattccgaagactcgccacaaaggctctacagccgacaccaccagccgggggcacggagggctggtcctcacgtacatgtcgaggtgacactctggacgaagaggcgccctccgttgcacggggagtacgccggctattacgccggcgctcgatgtcgttgcgggcatccggctccccatgctggtcctcccgagtcgaaggtgtcgacgagggagtggcagccgagtgccgtgcagccgccgccgctcgccgcgccctccgcctcgacgacacggagccggtggtagcggcgccggaggtcttggtggtagcggaccgtccaccagcacccaggcgctgctgtgccgtcatgaccaagttggccgcgtcctccagccatcgttgggctggagactccgggtcatggacgacaggcgggtgtcgtaggagcgcgccagcagcctgaagcgcaccctgaggcgtgctgccatcgccgtagacgaggaggcgacgctccccatcttgccgtcctcctgcaccacctgcgactggtgacgccagggccttgtcgaccttctcaagcgcctccccctgcttagggctttggcgcggaggaggtgggggagtacgagctcgacggcgtggattcggctccccgtcgtcgccgctcacactcggagagaggtcgtgcgcctttgcttgctcggccattaggctgaacaagggaaacttggcgcccacggaagagtctgagagctcagaaaacacacgccgagccccctacctggcgcgccagatgacggagctcgtggctcctcaccgggagaccgcgcaggcccccctttgccagttcggccgagggcttagggtgagatcccaagctctctctctctctctgtatgtggaaagatcgtctgttcgcaagagaactcgagacacggcgatgtatacaggttcgggctgccgcgaagcgtaataccctactcctgtgtttttgtggatttgtgtatggatgagctacaaagtgtgagccgacttctcccccgctctaggctctaaatctggcaagaatcaacccccccttctctatgggcaaggtcctccttttatacttcaaggggataccacatgcacccttccctttccaaactggactgttctttttctcttgaacgggcggagatcagcacggttgctgtccgaatgacgctccgatgggacagcccacacctacctccacttccgccgggggcaggtgcgtcgtgggaacgtggttgcgagctgacgacatgagcagtgtcaaaccggtcacaaatcggtcattcttgtccgccgcgtgtcagcttagcagtgtgcatgtttgcccttcttcgtgtaacaccttgcctgtaatggttaggatgaagcctggcataaatctaaccagggctaacgtgccatctctaagagataacacgctagctccggcttgagacgagttgcctagaggctttcgtcttgacgggatggggcaaggcgtgtgtcagaccgccagtcgccacctaacccttgatctgaccggtctgtgactggtcacagaccggataaaagagcgtgctgcactgcgttgcacgcagcgtaacacgcttgaccagactgcaataaatgctgttaggtgagcacagctgtgctcacttatcccatatatatggcgcagacttctttaaggggtcggggtgcctcggccctcggggccggggcaagcgcaacccgaccccccctcgggggaaatcacgaggagggcggacacctcaccctcgggcccaatcgtccccgaaggtgccaggccacgtgggcgattgcgtctgcctcaagcctctggtcatgatactcccggtcccatatcaccgacaatcgcagttatcacatgcggtaactttttcagtttttgaaaccatggtatatctcgcgttaaccatgtggtttttatgataactgtgttgttaccgtggtaaccaccaaaccgtgagatggtggtaaccaccaaaccgcggtttggtaaaccctggatatcactgatcatatctacactacttatttgaaagatgggacgaccaatctcgtcatgcttcttgcaatgagtgctttatactactcttagccgcaaccaaaatttaaatttcaaaacttaattttaaaactattttttatgattttatcatagtatatataacagttttacccataaattaatttttaattactaatagttaccgcttttaatcaattataggcgaaacgatgtgactcgatatcaaaccagcagcaccactctggctatgtagcgtttgttaaagcgattagctcgttggcttactaacaaaatatttaattagtatataattaattaagtattaattattatataccaggatgaatggatttgttttaattttaaagttcttctatatacagaaagtttttaaagatttataccgtttagcagttttaaaaatatatccgtaacgtcgtaatagcctatagaaacaagaacggcccccttagcttagggtttattccatagtaaaaaaaccggaccggcagttgaaccagaaaaaactgaaaccggccaccttgatggttcggttctgcttaaagaccgtccctgcaatcaaatcggtaaaaaaggggtgaaccggccattttttcttgaaccagtgaaccggcggcggttttttttaagaatcgaaccggtttttagtttgtcgaaccggtttttaatttatcctatggcagtatgacattataaatttattatgttaccacatcacatttattttttttaatgttgtgaccatataataatagatatactggtttactcatgcatatgttcaccaattttttatggttctatattaaaaataatataaatcaaatataatatttataaataaaaaaccagcggttcgaccgatcacctggcagagccgacagtcagagcgtgtcgacccccggtccgttttttttttcctatggtttattccagtctacgacgcggagcggaggagaggacggtaggtatggccctcgcggtccatggcggcgacgccgaagacgacgccattaacaaatctgaatgcagcagaccgagcaactgttggcaaggtacatataattatgaagattattccattagcttgaccccaatttattgttcacacacattcatactgcataatgcatgtaaatgcatcatacattcatactctaagacgcgcgcacaaaaagacacagctattaatttgcctctacgcatgttaagaatgtgctcctctggcctcctgtcgatatctacgcatgttaagaatgtgtagatcattgttacacatgttaaactctgaaataaagttgagtttgtttagtgcctcagatagtggaccagggagatacttcctcagtcttaaaataagctaacctattatgggattaaaataagctgacctattataggatgttatatattctatactacgaatctaaatagacacatatcatattacgttagtttattttgagatagaggggacaacacataatattaggttagtttattttgagatagaggggatagagggtgtacctcctcgtgcaatatttacctcttcactttagaattaaaaactatccttccctactttatcgaaaaccgtaaaattgatgactttcaatcaacacagtataaacatcaactaaaatcaattgattttcataaaacgatcactgacggtttcttaaaaaccaagcggtattttctcacattcatgtttagcttaatagtcactggtagagaaaccatctttggtcggtcgacccaaatccaaaatagttctagttccattaaaaatcgggactaaatatgatttttagtcccagttaataagaggaagatctttagtcccggttgtaaatcatctttagtcccgtttggtaactccaacccggactaaagttcatttttagtcccagttgattccatgtcaggccgtgtcagggccctagaatctttagtcccggttagtaacaccaaccgggactaaaaacctatttttagtcccggttggtgttactaacagggaataaaaatcaaaacacactatataatccatagtaccgatcctcttttcccgtccacataacaaactcctccctctgtctctttttttcctctctaacttcttatctcttttcttatctctaactccccctcctcttcttccttttttccttcaccccatagtgaagaagcgtgcaggaagccggcgcggcggcggcggtaggcggccggcgtggaggcggcctgcgcggcggcgcgggggccgcgcggcggcgcggaggggaggaggggaggcggcagtggccgccggccggattttttttctttttttttttgagatgtgaatctgtgatgtatttttgtgtgagatatgaatctgtgatgaatttttagaaccctgtgatgtaatttttttaagagtttgtgatgtatttggagatgatctattttttaagagtttgtgatgtatttggagatgatttatttgaggatttgaggatttggagatgttctgtgatatgtgatgatttggatatgggaggggacgatgtgaaatcaatattcaatattaaaaacagaaaaaaaaagaaaaaatatctttagtcccggccatctttagccccggttggtaaagatcgatttttagtcccggttatttgaaccgggactaaagatagcgatctttagtcccggattcgtagtcccggttgggggttacgaaccgggactaaaaagcacttctccaccagtgagtggtatcttctcgtcatgtgtgatgatattatttcacttatcaaagatgacatactatattatatattcatgatagattctaattcatttcaaagaacaaaaatgtcccgcattatctcacattcatgtttagcttaatagtggtatcttctcgtcatgtctgatgatattatttcacttatcaaagatgacatactatattcatgatagattctaattcatttcaaagaacaaaaatgtcccgcattatccaccgtttttttagtaaattgtattttgcaccaggtaaaatgcatcacgtttcgttttgcaccagatttattacatactttcacttaacatcaaattgtattgaaataagtttcactatatcatcaaatctattaaaatttcatgaaaactcataagttatgaagggaactttgtgaaacatggtaaaatttgaagaggtttcaaaaattttacttatattttacaggatttcttttaattatatgatgaaacctaatgcaaagtgaaatttattttgatatacaatgatgtagagtgaaagtctatgctaagccgaatgcaaactgaaaaatgaagtatattctaccctatgtaaaaagaggtaagaatgcaatagcccttttaaaattttaatcgcctaggcttcgtagagtgagccatggcagcagtaggtgatgatgggctggatatcctcacatgaaataagtccagtggtcatccctcaactttacatcgagcttgtttgatatcccttgtccctaataccagaaatcttcacccctaaacaggtgtggagacagcgtggggccgtgggggcggggggtctttagaccccctaccccctaatagaccattagagcccccataataccccctaaaattctaattcatatatttatagatgagggactaatatagactttgtttgaggttgttagaaggctcaaaaggctaagaaggcccaaaaaatcctaacccaaccctaaatctctcttagttgctcttggttattttagtttaaccctcgctatagttttatcctagctccgccactgcccctaaactgtataaatcagtgcaactttggtgccataacagtttcagcggctggtttagctcacgtggcattctagtcaagaaaaaaataatactacctccatattttaatgtatgacgccgttaactttttgtccaacgtttgaccgttcgtcttattcaaaaaatttatgtaattatcatttattttattatgacttgattcatcatcaaatgttctttaagcatgacataaacattttcatattttcaaaaaaatttgaataaaacgaatggtcaaacgttactcaaaaagtcaacggcgtcatacactacaatacggagggagtaaaaaaaatagtggggcccacatgtacggtccgatgcggagcacacgcggcatgggtaggccgtagtctgtagaggcttagggagcgattcctccgccgccgctgcggctctcgcttccgggtggtttctcttcgccggagccaccgcattgacccatgccgccgttctgctagggaggaagctgcggccttccgttgatgctgctcctccccgccggccaaaggagcttcgatccgaggtgctacactgaggtctacggcacgggactacccctcgcgctcgccttcgtcggcggcgacggctagctctactccttcgtcctctgctccggctggcacccaataacagcctccctcatccggctctagcttagcacctcctccgccctgctcctagtcctcgccggcctagccgcacgagctataaattccatgtcgaaagagtagagaaggggcagccaccggcaggagaaggaagtcgggccctggccatgtccgcccaagcccatgccgtgatggagtctctgaggactggcgcggtggccaacggcatggagatggaggtcgagctccaacgtggcggcactgcatcatcgagctcccttgtcctcctgctctgtacagggccggccctggccctatgcagccgaggcgaccgccgggggcccatgatggtggaggggccaacacctaatactagtagtctagtacctcatccgatgttgagatcaatgatctttattcagaattaaaggtgtgattcttcgatattcgcgcctgagattctgaagttcgttatggatgcagattgctatccaaatgttttagttgcctatcgaaatctcttaactgtacctatgactgtagcttcagctgaaagaagtttctcaaacttgaagttttgaagaactatttgagatcaactatgtcacaagaaaggttaaatggcttggctatgtgctcaattgagaaggatatcttgaacactattgatcttaataccgttattgatgattttgcatcaagaaatacccgaagaaatatcttttcatgggagcaacggatatgatggggttttgttattcattaagttaatgaataatgatattagttccaagttataaatatattgttatttttatttcttcataattaccagacatgttaaatttaatatatggatgtatttgttatcgttttgcaagtaaaattattatctatatatcataaaattttatatatagtttagagggcccatcacgatgagttcgcttagggccctcaaaatcataggaccggccctggctctgtagcagcctcgtaagctcccactgcggcctgcctcgtcgaggtcccccgtcctcaagtcgcttctagcgtcgacgagctgaggagctcccccactggaagtagggatgatggcggcggtgacctttggcaaggcgacgacgacttggaggggagggctcaattcggtcgctgctgccattccgattcacgattcacggccttcacggcttcacctccctctctcccctccctgattcagccaccaccggcgcggaaggagatgagagaagaccggaagaagagataaataataagggacagtagagtaagaaagtgtgtgtcacttatatgtgggtcccatatatattttttattttcgctgactcggatgccatgtcagataaacaaccctccatactgctgctagggacatggttttaaatatttgaggggtcgatatttctggtattggtattaggaattaggatgtcattcttacatactcgacgtaaagttcagggactagcagtggacttattcctcctcacatttatacccgtgtgctcccggcccaaacagctggacacgaagcccgtatgggcccaaaaaagcccaagtcatcagttcttccaccgtcagcccggcccatgtcgaaggccaggccgatctgaaccatcgccatcctcgccgtccggccaccgcccaccggcaaacggcggcctcgctcccgctccggcgggctgcgggggcagaggcaggccgcgggagaccgagaggcctaccgtccggtgactcctagctcgaggccacccgcgggctatgctcctgattcctgaggtaaatcaaagctagtggagtaccatggcttggttgattctccagtgttgtttagagatcggggaaggtggcttcaaatgcttggttgagatttatggcgtttctcgatgcggtattgcagtgtcgtttggttgcggattagcggcccgcgcgtggtggattggagatacagcactcgaaatatagtcacaacttgatactgcaggtacatttgtattcatgcataatcgtgacatgattcggttactatcagatttcagtttattttagttccttccagttttctacttattgaagcagattgtattaactcaatttcactactacatcacaaagctggacaatcaagtaagttttgcctggcctggggtgtcaatatgtcatcttgctggggctggagccactgaattagccttgctgaagtgagaaccacttgagatcactagccactgcttatcttctaaccagcatggcacattatttatcgacttgatcataactggtttagccaaaatatctgggcatggttatctgatcatatagcacacctactccaaagaacacaccaaatgcaattgcaaacactaccttgtcaatatactgctttgcggagataggggttgttggagctgctaccgctgaattgcaatggtgttcaagcatagggctgcatagctttgggttcccagcaaaactagaacttaggaatgtgctgaactggcctccaattggtacaggcccttcaaggtcattgtaggaaacattgaattcagaaaggaaatgaaggttcaccagccctgatgggattggacctgtcagatggttggaagacaggtctagcaccatcagattcttgaggttgctgatcgcttgtgggatctccccgtttaagttgttgaagctcaagttgagtgaaagcagttctttcaactgaccaatctccatggggatcacaccacttaatttgttgttacctagattcaacatttttgggaatgcactagtcgcacggtactgaaaacacaaacatgcgcccacataaactgtaaaaggggagactattaggtcagggtgatcttcaatcttgtccgattttagcattggcatctgcatcaatgctgttggtatttctccagtgaggctattattcgatatgtcaacatacttaaggaagttaaggctactgatccaggttggtattggtccactgagttgattgttatataatgctaaaagttgcaaacttctgagctttgatagccaattaggtatttttccagtcagtgcacaatcatttatgccgagaccctgaatattcttaaaaccatcaattgtttcatcctctggcatagcttcatgcatgaagttgccaccgagtagcaagacagtgagattccttaagttcttcaatatgtggagtgtatttgtaatatttttaaaattgttgtaggaaagagatatgaaggtgatggacttcaaattttctattttctttgtcaactctccatgaagcttgtttgtggatagccgcaaccaagtcaaattactgcatgagtagatgctttctggaattgtgccaatgaagtaatttgaagataaatctaaaattttcagattgggcaaggtggagaagttaaccttggcaagctctcccttcaacttatttttcttgaggttgatagtaactagatttgtgcaatcacccaaggttggtggcagctctccagatatgttgttttcttccatgtgaagttcttctagtctcttcagttgacctatagaatctgggattttgccactgaatctgttcccaccgagatcaagaaaacctagattactgagctttatcattagtgcatcgtcaattattccttgcaagtggttattaggaaaggagaggtactccaatgaggtggctctgaagagatcatctggcagggtcccaatgatgttgttttggccaaccctgagcattctaagggaggagcatttacctattccaggggggatgctgccactgaattggttgtaagaaaggtcaagcacagcaaaggatggtgagctgatgcagaaagaggaaggtatgtgcccactaaaactgttgttgctcgcattgattgctaccaggttgctcattttctcccatgttgtggagggaaatgctcccgtaaacaggttgcttgagatattcagtacctggagaggccggtcaggtgatgacgaattcagctcctgcaattctccatccaggcggttgaagctgacatcaaggacgacaatgctgctgaatatcagctctgatggaagctcactggagagtaagttgtatgacaggttgagtcgcgacaagctggtgagctcgctcagggatgatgagatgcacccttgtaggcctcttgaggccagtaatagctcagttactgcaccatcttctccacagatgatcccttcccaggtgcaacaatctgtactattctgccatgacgcagcgaggccaccatcctgcgatagcctggtgaggaactggaggagggagcgcctctccctctcggtgcatgaaccgacaggtgagatgaaggtgaacagcagcaacacaagaacagggccaaagaaatttatgcaaaacctgctggttttgttgctgcacgaaaaatgtggtattggcttcatggtttgtatcagttggaagctgtgacagaatagcgagcttgattcaccaagataggctggtattgtgggcaaaaccatagttcatgagcgatatattgtcgaagcatcgaagatttacaagttggagtgttgacctatgggtttactcgctgctacctcactggcttgctgctatgcttaggtttggaaattctgtccaactatggccgttttcttttaccagtcttatgttttgtctcatgatgcttcacaggagggcttccacttaaattggatctttccttgtacaaatggccacttgactgctatttgttaaattctccattcgtttactccttagtcgtaaagcagagtcatagtccaggtctatgtcatctactgatctactttttatcccttttgttttcatggagggaggtatagcgtacattgtgcttctaatcttgatacttccagcagctgtattttgactccgtcatcagcaaccgatttgcgactgatgactgttcttggcttgtgataatatacaacaaatctgttgtaaaagattacttctcttatcttgaaatagtttggctacactactactaataatgtaatggatgcaggtatgttacatgttcccgtgctgctggattggaatgcgtttgcgttttcctgtttgaacaaaatgtgatcaagccttcaagtaaaggctgttttaatctttgatgcactcggtgtgtgatgtaaagcttgtgctgctacagttctacctacttagtagtattttgttttaattttcagtttatatcccttcgtagttcgttgttgttttctaaagaaacttcggcgaagtgtgcgtgaaatttctgtcacagacaagttcttgcagtcggcattcgcgtgttccagattttatacagtataaagtctaatactactccctccgtttcacaatgtaagtcattttagcatttcccacattcatattgatgttaatgaatctagacatatgaatgtgggaaatgctagtatgacttacattgtgaaacggagaaagtattatattatcttcgatcgcgttggctcttgtaaggcctggttttgttcccaaattttttcttttaaaaatgtcacatcgaatctttggacacatgcatgaagtattaaatatagattaaaaataaaaactaattgcaccgtttgcatgaaaattatgagacgaatcttttgagcctaattagtcaatgattagctataagtgctacagtaccccacatgtactaatgacggcttaattagattcaaaagattcgtctcgcggtttccaggcgagttatgaaattagtttttttattcgtgtccgaaaaccctttccgacatctagttaaacatccgatgtgatatctaaaaattttcttttcccaaactaaacacaccctaacaaacttgtattttatatttcttggggcccttatttcaagactgctactccctcccagcgtttttttatggccaggaattttttactatgcagcccttgtactagcatgtcactctggccgtgtttagattcaatttttttcttcaaactttcaacttttctgtcacatcaaatatttggacacatatatggagcattaaatgtagaagaaaaaaaaacaattgcacagtttgcctgtaaattgcgagacgaatcttttgagcctaattacgccatgatttgacaatgtggtactacagtaaacatttgttaatgacagattaattaggcttaatagattcgtctcgcaatttacagacggaatatgtaatttgttttgttattagtctacgtttaatacttcaaatgtgtgtccgtatacgtaaaaaaaaatttggacacgaactttttttttgagggaatgccatttgtcaagctttattgatcattaaacattgttacatcgtttgccaaggtgcttagaatataatcaggaggttcatcgtttgccaaagtgcttataatataaaatttggacacgaactaaacacagcaactgtctcctgcccttgttttcaaggaaatatttgacggtggttattgttgaaaaagtcgagacgacgtgtacgagaaaaccgcatgaggcatgctggccgatatacgtagcatatcaagttcttgacattttttagcgagatcgttctagatctcctttgaaatggaagaacttcactgatttttacgttcaaaatgtcctggcctgtttggcaagagaatgaaagaggaatgggagttttaaggaggaagttgatggtgggattggtcatgggagttacatttttagtctccattccttatttggtttcacatcgaattccctccaaatctcacgaattaacgggcctcccctaggtaagagattgatgggaattcgaccttttaattccccatcccaaaccccctcgaattcccaagtctttcaaccaaactacagacttaaactccccatcccaaaccccctcgaattcccaagtcttccaaccaaattacagacttaaactcccagatatcataaactcccattccccatcaccaactccctccaaccaaacaggccgtccatgaaattcctccgttccaaagtactcggctactcgctctatctaaaaatctaaaacataccatttccatattgtaatgtatgacgctgttgactttttattcaacgtttgaccattcgtctcattcaaaaaacttatacaattatcatttattttattgtgactcgattcatcatcaaatgttctttaagaatgatataaatactttcatatttgcacgaaaattttgaataaaacgaatggtcaaacgttggtcgaaaagtcaacggcgtcatacattaaaatacggagggagggagtatttattctatcatcgatattaagaagtaattaactcgttcaagaagagcgtccgcggccggagggcaggaacagcgatgcgaggcagccggcggagcggcggcgggccacgaagttgccgtgtgtccaggtggtggagttgcacggcgcgctgcacagcgtcacgtcgcccgggtgaagggcgttgtagtgatccaggcactcccgcgcgagccgctcgttggactcctcctccctgagggcggcggcgcggcgccgtctggagtagtagtcctcctccagcgtgatcggcggcggccatagcgcctgcgccgcctcctcgtcgccgaccatggctgcgtccaggatttgcgtcgcgatcgatcggagaatccgggagcctttcaggccctgtttagatgggagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattatctaattatagattaattaggcttaaaaaatttgtctcgtgaattagcttttatttatgtaattagttttgtaagtagtctatatttaatactctaaattagtgtctaaaaatagggactaaagttaagtccctagatctaaacaccaccaatctcgggaagaaaacgtcaaatactccatcagagaagaaatcacccgatagagcaaaatctctcgggagatcgccgtttgattcgattcatactcgttgccgtgggccctgaaataggttggcaacgttgcatgatgggcctcggcatgcttagcttcttttggtcctgagaggccttgtggccctatatcatgggcccaaattgctatccttttactgggtgtgtgggctaaaaagtggagccacgcagacacgtcagcaggagtagacaaaatcaatgtgctatgtaggacgaaatcgtcgtccaaaccactaaggctgtgttcgttgacaggtgataagggagattgtgaatcgttttccacgcgcacacttttcaaactactaaacggtgtgttttttgtaaaaattttctatagaaaagttgttttaaaaaatcatattaatcaatttttgaagtttaaaatagttaatactcaattaatcatgcactaatggctcatctcgttttgagtatcttcccaatcttctcaatctctctacatgcactacaatccctttctcgactatatttcagttgtcacaaattacagacagagatcccaactcataaacgtacatgtgctagatttatgtggcaaccatctaaaaaaacaatatttgaagggagagacatccctctaaatttttaaaatttttaaagaagacattgtgaacgtgttcgagattgaacacgggatctcagaattgaaatcacacactccttaccattacagtatcaaatgcatgatgcatctcaatctatctagcaaccatctcataggtccaataccggcctgaggcactgaacaaggagctccacttcctctcaaactttaacatttccaacaatgatctacaaggttcagatgagcacattatcaaggtcaagtttgagttttgatgggaacccaaagctatgtggccctgtgttgggtaatgattgtgatgattcagtagaggcagcttcctcgcagccatctctgaaaaagaatccagcatcaaaaagtcattgcagcgattgcctttggcgtgttctttggaataggggtgctgtatgaccagctactcttgtccatctattttggctaacaatggcaacatcttcataattctgtccagactgtccttgccaatcgttaatgccctgagttgctcgatttgcattcaaacttggggcatgtttagttcacttcaaaattagaaatttgattgaaattagaacgatgtaacggaaaaattgaaagtttgtgtgtgtaggaaagttttgatatgatggaaaagttagaagtttgaagaaaaggtttggaactaaactcggccttgttaatggcgtcatcgtcaccatggaccgtgagggccgcacgtacggaccgtcctccactgccattaacaaggctgggaccatcatttctataaggaagtcagtctgcaagttcatatgtgacatcctggttcaattaaaatgtgaacgaactcgaggaagttttttcggaccggctacagggacatcttcgacatcgtggtcgccttggtctgctggtccatatggaaagaacgcaatgcgaggatcttcgagcataggatgcgcacacctgaacatcttgtggatgatgtcgaggaagaaaccctagtgtggaagacagcaggggttattaaaccatgtaataacgagaatcactgattagagttcgcctccgggcctgagggcctagccaacatccaattcgacagtttactgtcattgtaagctatctgtattgtttcattacctttctttcttaatgaaattggtcgaccgaatctttcggccgacccggcaaaaaaattaaaatgtgacatatgtagcaaatgagtaaaatgtgacatgtgtggcaaatgagtactgcgtacacttgattagtactatctcgctagttgagcaaatgtacttataagaccttatcccttcaaccataccatttttggttgattaccattttacacgaagtgaaaggataaaaatgtaaataagatgttatgtgtgaggatcctttatcataatgtcgctaccattagaatcactggtatgtgggttacatcctcctattgcctcacacgttagtgtatgtaatgatagtattattgtggacctaaagcgcaggttgttacaccatggctagcagcctagcagaaattgaactggtgatttggtgaaggagcaaaatgacactagtctaacaatagcttattttgacagcccatatatttatccctctattcttgaaaataattcgtatatgtgtgtatttttcgtttcgtctgatctctttttcattgcaaatcactcagtgcaagaagtaggacgtgatcattagtcccatctgttgttttcagataagtagatatggtcagtgatcctgataagcacttatataattactgaggtaatctggaatcgatgaacgaaagaaatcatgcatgcgttccctgttcgcaacataaaacagttcacacaaactttactgaaatttccatatataactacaaagaactagaaagaacaactgacaccaggaagaatgcagaaaagtctacaatattatcaagaaaagaacatatttgccttggaccacataggacagtcaccttcctgccatgccaattttaggatcacatgctctaattgccaaagtgaaattgaagtactaaacataaaatgaaaacaacgtgatagataacagtttggcaaatgggtacttcagttgtcctatttagtcattcaaccacgaaattcatacctcgggacttcgaacgcggtctgttcaaacatgcagggttcgaaacatgcattcagttgtgtatatatatcctcaccgaacagtgtaacttttcgcgaacaaatattagttgccaaattctaagtccaaacactgctgtgatgggagagatcatgaaggaggcaccacattctctgtggagaagcaggctagggatgcctttctcaggtctcgctgctgctgccttattgttgctgctgctctccatggccaactccaccattgcatgccttgagcaggagaagagctctctcctccggttccttgctgggctatcgcatgacaatggcatcgccatgtcgtggcggaatggcatcgactgctgcgcgtgggaaggcatcacctgcagtgaagacggggctataattgaagtctatttggtttctaaaggcctagaagggcagatctcaccatcccttggagagctcagaagcttgctgtacctcaacctgtcctacaacttgctctccggtggccttcctgaggagctgatgtcctctggcagcatcatcgtccttgatgtcagcttcaaccgcctcgacggggacctgcaagagctgaattcatcagtatctgaccggccactgcaggttctgaatatctcaagcaacaggtttacaggagaatttccatccaccacatgggagaaaatgaggagcctggttgcaatcaacgccagcaacaacagttttactgggcagatagcttcctctttctgtaccggcttgccatccttcgccatgcttgatgttagctacaaccagttcagtggcagcatcccccctggaatagggaaatgcactgcccttaaagtgctcaaggctggtcacaacaacatcagtggagccctcccagatgatctcttccatgccacatcactagagtgcctctcttttcctaacaatgatttgcaaggaacaattgatggtgtactcatgataaagctcagcaatctggtttttcttgatcttgcgtggaacagattcagtggcacaataccagattctataggcaagctgaagagactacaggagtttcacatgaacaacaacaacatatctggggagctgccatcatccttgggtgattgcacaaatgtaatcaccatcaaccttgaaaataacaagttggcaggagagctttctaaggttaacttctccaacctacacaatctgcaagctttgggcctttcctcgaattacttcaccggcacgattccagatagcatctactcatgcggtactttaacttggttgaggttatctcgcaataagcttcaaggtcagttgacggagaaattagaaaatttgaaatcccttaccttcgtatctctttcctacaacaattttacaaatatcacaggttcacttcacatactcaagagcttaagaaacctcactaccttgctaattgggagtaatttcatacatgaagctatgccagaggacgaaacaattgatggttttgagaatcttcatgttcttgccataaataactgcgcactgactggaaaaatacctaattggctctcaaagctaaaaaagttggaacttctacttttacacaacaatcaactcagtggaccaataccaacctggatcaatagcctaaacttccttaagtatatagacttatccaataatagccttataggggacataccaacagcactgatggagatgccgatgctaaaatccgacaagattgaagatcacccagatggcccaagagtctccccgttcacaatttatgtgggtgtatctttgtgttttcagtaccgtgcagctagtgcattccccaaaatgttgaatctaggtaataacaaattaagtggtctgatccctgtggagattggtcagttgaaagcactgctttcactcaacttgagcttcaacaatttacatggggagatcccccaatcgatcagtgacatcaagaatctgatggggctagacctgtcttccaaccatctgacaggtgcaatcccatcggcactggtgaaccttcacttcctttctgaattcaacgtttcctacaatgaccttcaagggcctgtaccaattggaggccagttcagcacatttccaagttctagttttgctggtaacccaaagctatgcagcccaatgcttgtacagcattgcaatttggcagaagcagctccaacctcccctacctccacaaagcagtatattgacaaggttgtctttgcaattggatttggtgtgttctttggaataggtgtgctatatgatcagacaatcatatccagatattttggctaaagcagttccaatagagacagtcaatagtgtgttctagcttcttctttttaaagataatggaagcttttattgaactcagcaaattatatcgaggagatacgagagcacactctcgctctctacatgtgttctggcttagtggcctgtaatgcaattttgtagtttactcgagtgattttcacatttcacttagcaaggccaaactctttgatgttctagtgaacttcagttggtacagtctgctccaacaagtagaaagaagtaaactgaaatctgtcagtagatgagagtcaagtgaaactgtgaaagttttacgtgaatgtaaatgctcctccattaatttgcgactacatttagaaatacttctctgaaatttggcaagagaggggatcacaagtctgaaactaacgaacactgcaataccgtgatcgacgcgaatacgcgatagatctggccgaggcgccgagctattcgctgggcggttgtggaggatcccttcctggacgcggctcaaatcaggtgggggagaagaagacaaggctaacctcgagtcctccgcttctgatcgagaagagcatctccgctacgccttcgtctcgcttcggctgccggcggcagtgcacggcgacgaccgggaacggccgtgggacgacccatattatctgggccgttacggtattatgacttgaggaatatactacctccatcccaaaatgtttgacaccgttgatttttttaaaaatgtttgactgttcgtcttattcaaaaaatttagtaattgttaattctttttctatcatttgatttattgttaaatatacttttatgtatacatatagttttacacatatcacaaaagttttttttgaataaaacgaacggtcaaacatatttaaaaaaatcaacggtgtcaaacatttagggaaggagggagtagtgaatagtccctcaaatataggttcaacctttttttcggggaatgccattcggctagctttattgataggataaaattgttacatcgtttaccagatgattcagaacacagccaggggagggggttcatcgacccaagtacaagaattttttgtcctaaacgctaacctggccagttcatgagccatctgattggaatttctattacagtgctcaatagaaattgtaccaaaaccatcccacatcagcttgcaatcatcaaacacagacatagccgctgtagcagaaaatcctccatccatcatcgttgaaaccacctgcatacaatcagtttgtactataacatttttagcaccaatgtgttgcgccagggccagcccatctctcagcgcaaaagcctccgccatcgtcggtgcatcaaggacatatggaagaaatgcttgagaagccgtaacacaagctcccaagtgatctctcaacaccaccccagtacctccacttcccgaatcaatatcgaaagcagcatcaacattgatcattagcattccttcaggaggtttcttccaaccgttctgaatttttgttttacctttcttatttgacaacatatagtttgttgttaaggtagcaatgtcttgttttacctttcttatttgacaacatatagtttgttgttaaggtagcaatagacattgccgaccgagcagggtgctgtattcattcaccatgcaccaactgtcttctctcctaccaaatataacaagctccctttaagatcaattctgccattctaatagcattcagatgcgaaacctttccaccctttcttatcacctcctccaccagaacagatcctgaccggtcgaaacccagaatcggttgtattctgctccatatgcctagctgcttccaaatcaacttcaactcaactttgctcttttacaagtaaaaaccatatgcttgatatcttcaactcaactttgctcttttacaagtaaaaaccatatgcttgatatcttcaactcctgaagaacaaaccggacaaccaccttggactgcaaccttaatgatattgtgagcggttttcactttgagcaactactagctccaaatcatatatagccaattcatgcaatagttacaatatctataaatatatactccctctgtcccatgatataagagattttgggtggatgaaacacatcctagtataatgcggtctgtccttggtcggttggccgacccggcaaaaatatttattatactaagatgtgtcacatccacctaaaatcccttatattatgggacggagggagtactacactattaatatctagtctcacctatcatacatatattatgttttggaatccgtgttgtaactggctataaatctatagcccactactcatctctcttttcttttatctcatcgctatggttagctcacagtatgctattgtacctgctctaatataagtatgtaacttgttgattagttcaaccgaccgagtacacatacgagggccacaaatcagtgtctcctctctttgatttttctttcttttctccctcccctcttttcgatgtggcggagcggatagcggagcaagccgacctctgcccctcttctccgctgtcggctcctcttcttcccgagcgaagaggaagggcaaggagccgagatgccgacggctgtgagatgcagttgtgaggaggggcacagaggaagggctggcggcgagcacgatgctgccgcttgcatttctctcctctccgtatggcttggacgggcgaaagacgactaggcaatgtgacgcctgctcgccgctcttcttcctcttctcttttttttttatcttaaacgtgctctttattagctcgttggtttagtacggtcacgagataccagcacatttacaaactctggaggaggtcagcccaaacagacatctgacccggatcccaactcatacttagacgagcaatgtcatgagcacaactattacaggagcgacccacaaaagacagtttagaattcctcttctctgccttctcctccagcacgtcgccgcgcaatcaccggccttgtcgagcttggctgccatatgggttagttggaccgttacgggatttcattttcttgcggcccagtaacggaatttggacttacgtgcggcccattttggttgggcctaggctcgtcgattgatcagccgccatggcccccctcctccacggcgaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgttcgctctcgggcgacggccgtcaacaaaatttgcaggcggcccccttgccgccctccgcgagggcgattttctactgtgcggggggccgcctgcaaatgggcggcgagggggggcatggaattttgcaggcggcccccttgccgccctccgctagggcgattttgcactgtgcggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcattttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttaccaacaacactgctgtacatctcacttgccacaaaaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcatgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaactcgtggtctgcgagattgctcatctgtttgcttcgttgtcaactcatccaacttgtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctgcaaaattccatgccccccctcgccgcccatttgcaggcggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcctccacggcgacccgctcgccgccgccgcgccgtcccccatcgtcgccgccgtctccgcggggcggcgaccgcagcgatgtttcccacgagcagcgaaacccacgaggttagcccttgatctgagcccccgcggctaggaagaaatcccgcatcacgtagtataatactatttacgcattcgatttactaacagatttcagtttacttccaatccacttcagtttcttcccaattttctactttttggagcatacactgcattaactgaatctcgttggcagatcacgagctggccaatcaggttttcctttggggtgttcatcttgctgggggctggagactgtggagccactgagtaggccttgctgtagtgagaatacttgaggtcactacacagttttagagatgtctatagcaaattactagcaattaagaagtcacagatgttgattgcttgctctgctctatgacccattgttcatatctgcaatccagcgcgcgttttgattgaattgataatactgtaactgatttagccacaaaaaaaaaaatctggatacagctatctaatcatacaccacacctactccaaaggacacaccaaacgcaatcgcaagctttgtaaaaatctggatacaactatctgatcatataccacacctactccaaaggacacaccaaatgcaatcacaaagacagtcttgtcgatgtactgctttgtggagataggggaggtcagagcttcttctgtggaattgcaacggcgcgcaacaatagggctacatatctttgggttccctctgaagctaaagtctggaaatgtatcaaactggcctccagttgggataggcccttctaggtcattgttagaaacattgaatgctgagaggaagtgcagattgcttagtccaggagggattgcatctgtgagatggttattggacaagtgtagaacctgcaggtttgtgaggttgcagattgattgtgggatcttcccggataagttgttgaagctgaaatcaagcacatgcacttccaactgaccaattatcggggaaatttcacctgtgaagctgttgtagctcagattcaacaatgtagggaaagcagtaagagcacggtattgaagtgatggaccattatagacaggaatctcaaaaacccttgggtccacatgggttacatatttttcagatctgagcattgtcatattcatcagattgattggaatttcttccgtaagtctgttgtctgacatatctataaagaagaggaggtttagggagttgatccaacctggtattggtccagtgagtcggttggcacttaatattaacatttccagattcttgagcctggatatccattgaggtatattcccagacaataagcagccgcttatgtcgagaacttgaagattcccaaaaccatctatgttttcatcctgtggcatgatctctcctctaaagttgcgcccaataagaagggtggtcatggtcctgcaacttttaaggacctgaagtgcatttgtgatgtttgtaaaattgttgttagcaagtgacaagaaggaaagatacttcagattgattattcccgatgataactcaccatggagatggttagcggataaccgtagtgctttcaaatttctgcatgagtagatgcttactggaattgtgccggtgaagttgtttaagtaaagatctaaagttcttagattatgtagggcggaaaaatcaaccttgccaagatctccatagaagttattgtgttttaggtctatgaccttcagatttgtgcagctgctcagtttccctggcaactctccagacatcatgttgctacatagatgtaactcctccagttgcttgagctggttgatagaatctggaatcttgccagtgagctggttccatcgaagatcaagagtagccagatttttcagtttgattaggtgtgtgccatcaattcttccctgcaatccattgttaggaaaagagaggtactccaatgagatagcatcgaagagttcatctggcagggtcccgctgatgttgttgtacccagccttgaacattttaagggcagagcaattacctatcccaggggggatgttgccactgaaccgattgtaggaaaggtcaagcacagtgaaggatggcgagctgatgcagaaagaggaaggtatgtacccagtaaaactattgttgctggcattgatgacgaccaggttcctcattttttcccatgtggtggatggaaagtctcctgtaaatcggttgcttgagatgttcagtacctgcagtggccagtcacatactgatgaattcaattcttgtacttctccgccaaggcggttgaagcagacatcaaggacaatgatgctgctagaggacatcagctccactggaagaccaccggagagtgagttgtacgacaggttgaggcgcgacaagctggtgagctctcctagggatggtgagatctgcccttcaagacctcttgaggacagcagtagctcagttactgcgccgtccatgctgcagatgatcccatcccaggtgcaacagtcggtgttgttcctccatgacatggtgaggctgctgtcctgtgaaagcccagcgaggaaatggaggagagaactctgttcatgctcggtgcatgaactgacgggagtgacgagggttagcaatagcaaaacaagagcaaggccaaacaaatgcatgcaaaaacttctgcttttgttgttgctagaagaatggagtattggtttcatggtcagtatttctgtgggaaactgttatggattatccagcttgatttgccaagaaaggctgatactgtgtgcaaaaccatagttcctgagcaatatattgtcgaaagggtggaagaattataagctgattgaatgttgacctttgcgtttacttgatgctgcctcactggcttggtgagctggtgctatgcttaggtttgtaaattcagtctattatttgctttgttttccaccgacatgatgtgttaggcacacattgtttgacagaaatgcttgcaattgaattggtccaagtatatttcttcatacgtctgccacttgagacgcactaaggcagtaagctatttgaaacgattttgttaaaatcatcattccattttactcctgaagcagtagcagtgtcatggtccaagtctattggactattactctactgatttcctttgatgacgactatgccggcctgcgattaatctcagacatcagctgcattttttataatctgtctcagacaatctatttccgactgttgactgttcttggcttgtgataatcttttataaaaagaaaagaagaagattgacctgctctggttgcatatcctgtttttcttgagatggttggattaatgaaactgtaactgatgcaggtatataacatgtttgcgtagtgctgctgaaattcgtttgcgtttgcatggtagaacaaacctcgagccttcaaatttcaagtaaagttgtgtgataatccttgattgaccctttgtgtgctgtacagccatgttgttatctacaagtactggtatcttgtttttatttcctttttctgttcatatcttctcgttgttctctgtgaaatttctttgttacattccgttcttgcattcgcatattctagattttactctcttggcttggtttaagatggctgaatttattggataatctgatttttatgatagctatttgagggtataaaagaataaattaactacataaaaaatactccaattttttttccttttggcacgaaacacacttttgaagtagctcggaaaacgtgcaaacaatgatctagaatcctaaatcacataagaacatattttgtattttaaaatacaacatatgtcgttcaaaatatatgacgctgtcgatttttgcactcctttggatcattcatcttatagcaaaatcgtataccatctacgtgcgttggaggatttcgacttacgtgcggccgaaacgggattacaacttgtatgcggcccatattttttgtgccgttatgggctttctctttcctgcggtccaagaacggggcgcaggggatctcagcttacatgaggcccactattgttgggccggaagggaagtggactcgcgtgcggctcatgttggttaggctcatgggctctccggtcatccagccgccgacgccgacgccgacgccgaagccgacgggcgcctcggcgacgttgaagacaagcctcgccatggccctcctccccgcggagccgccgccgccgccatcgacgcatgagtggccgtacgtggtcgtcccaaatcgtcgccggcggccgaagcgtgaagggctgcgcccgcagcgatgttccccaggagcagcgaaagccacggggtaagccatgccttctccctccccctcttgatttgagcccccccgcggctagtaaggaatcccccgcaaaagatcggcgaacatcgcacccagatctatgagcggtgtcattggtactcacaaattaatacaaacactgaatgtttacttgagtccaattaagttccttccgattttctactttttggatcgtactgcattaactgaatttcactaacagatcacgacctcataattcaggtttgcctgggatgttcatccagccgggggatagaaccactgagtcggctttgctgaattgagtaccattcactcactcagttggagaaggtcatatggtaattacaaagttgcagctgttgcttccagttctatacccattgcatatgagtgcatactgttgattgtccctatcgtaatcggtttaaccaaaaatatctaggtagaactatctgatcatatagcactcctactccaaagaacacacagaaagcaatcacaaagacaaccttgttaacgtactcttttgttgagttcgaggaagacaggtcttcttctgctgaattgcaatggtgcaaaagcattgggctgcatagctttgggtttccagcaaaactagaacttggaaatgtgctgaactggcctccaattggtacgggcccttcaaggtcattgtaggaaacgttgaatttagaaaggaagtgaagattcattagtgccggagggatcgcacctgtcagatggttgtatgacaggtcgagaaccatcaaattcttgaggttgttcattgattgtgggatctcgctgtttaagttgttgaagctcaagttgagtgaaacaagtgcttttaactcaccaatctccatgggaattgcaccagtgaatttgttgttacctagattcaacattttagggagagcagtagctgtatggtactgaaaacacaaacatgcacctgcataaaccggaagtggaaaggctattgggtctgagttatctgcaaccttgtctgactttagcattgccatctccattaatcctgctggtatttctcctgtaaggttattattggatatgtccacatacttaaggaattttaggctactggtccaggttggtataggcccattgagttgattgttgtgtaaaactaaaatctgcaaatttcggagcttggagaaccaattaggtatctttccagacagtgcacaatcctctatggcaagacaaagaatattctcaaaaccattaattgcttcatcctgtggcatagcttcatttttgaagttgcccccgattaacaagacattgagattccttaagctcttgagtatgtgaagagtatttgtgatatttgtaaaattgttgtaggaaagagataagaaggtgataaacttcagatttcctatattctttgtcagctggccgtgaagcctattggaagatagtcgcaaccaagtcaaattactgcatgagtatatgctttctggaattgtgccggtgaagttattcgagccaaaatctattttcttcagattgggcaggtttgagaagttaaccttggcaagctctccttctaacttgttgctcctgaggttgatggttactagatttgtgcactcacccaaggatgatggcagctctccagataagttgttgctgcacatgtgaagctcctctagtttctttagctggcctatactatctgggatcttgccactgaatctattccatccaagatcaacaaaaacaagattacgtagctttatgatgagcgcgccattaattgttccttgcaaaccattgttagcaaaagagaggtactccaatgagatggcactgaagagatcatatggcagggtcccaataatgttgttgtgaccaacctttagcattctaagggaacagcatttacctatcccatgggggatgttgccactgaattggttgtaagaaagatcaagcacagcaaaggatgatgagctgatacaaaaggtggaaggtatgtagccagtaaaactgttgttgcttgcattgattgcaaacaggctgctcgttttctcccatgtggtggagggaaatgcacccgtaaacaggttgcttgagatatttagtacctggagtggcctttcaggtgatgaggaattcagctcctgtaattctccatctaggcggttgaagctgacatcaaggacgacgatgctgctagtagatatcagctctgatggaagcccgccggagagcaagttgtacgacaggttgagtcgtgacaagctggtgagctctctcagggacaatgagatgcgcccttgtaggcctcttgaggccagtgatatctcagttactgcaccatcttctccacagatgatcccttcccatgtgcaacaatctgtactattctgccatgacgcggcgagaccactgtcctgcgatagcccggcgatgaaccggaggagggagtgcctctcctgctcggtgcatgaattgacaggagagatgaaggtcagcagcaacacaaaagcaggatcaaagaaatttatgcgaaacctgctggttttgttgctgcgcgaagaatgtggcttcatggtttgtatcagttgtgagcttgatttgccaagataggctggtattgtgtgcaaagttatagttcctgggtaatatattgttgaagcaccgaagagttataagctgatggagtgttggctgttgacctatgagtttgcttgatgctacctcactggcttggagctatgcctaggtttggaagtttagtctaactatttttgttttcttttgccaatcttatgcgttagtctcatgatgcttgacaggagtggttccacttaaattggatttttggtggtacagttgccacttgactactacttcctccgtttcatattataaaactttctagcattgtccatattaatatagatgttaatgaatctaaacattaacatctatattaatatggacaatgctagaaagttttataatatgaaacggagggagtatttgttaaattctccactcgtttagtcctaaagcagagtcatagtccaggtctatgtcctctagtgatttcctttcatattcttttttttctagatgcaggtacggcgtacaaccgaacactctgcttcttctagtctcagtaattccagcagcatcatttgagttattttgtgactgttgactgttcttagcttgcgataatctttaacaacaatcaaaagattgacctcagttggttacattacctcttctttttctttttttttaatcctgaaatggtttggctacacaattaaaagagtaactgatgcaggtacattacatgtttgtgtgctgctgggatgcgtttgcttttgcttggttgaacaaaatttggtcaagcctgaaaatttcgaggttgtgttgtataagtctgtactgccgtagtgctatctagtacctcctccgtttcacaatataagactttctagcattgctcatattcacatagatgctaatgaatctagatattattatatataaagattcattagcatctatataaatatggacaatgctataaagtcttacattttgaaacggatgaatagtagtatatattgttttcatttcatgaccctttgttgttctaagaaatttcaacaatgtcaataaacgttacggcttataattaagtgtagacgaaatgattggagtcgatatcaaagcagcagcgcaccactcttggcttagcttcggcctcgtttagttcccaaaaaattctcaaaaaattcacatcgaatttttggacacatgtatggagcattaaatataaattaaaaaaactaattgcatagttagagggaaatcgcgagacgaatcttttgagcttaattagtccatgattagccataaatgctacagtaacccacatgtgctaataacggattaattaggctcaaaagattcgtctcgctgtttgcaggggagttatgaaattagtttttttattcgtgttggaaaacctatttcaacattggatctaatatttgatgtgacaactataaattttccgcgaactaaatgagacctttagctttggttattccgggctacgaggctacaaccgtaggatgtggaggaggaggagacgacgacgacgacgacgccattaacgaatctgaatggcggagaccgaacaacccaagaccagctcattaattaactgttggcaatcgtacatacaattatgaagatagttaaggatgtgttcatctggcctcctgtttggaaaaggatcttctagatcattgttagacatgttactgtaatctctaaaactagctattccccacgttttgctgctgaaattccaaagcagcttttattttttttaataatagagctaaaagtgaaaaatatattagttattaacaacaaataaaactggtttgtcaaactatgttcagagagaaaagaaatgcatgtagtacactatgtatgagattgtagatgaaatatatctcgcactttgattatatggatgaatatatattaagtattataaaaatgatggatatatatatgtgtgttaaaaatactatgaaaaataatgtgaaggaagataattggatgttgatttgtataattaaatgaattatagatgatgttgtatgcttgcataagttttgtatgtaattattgctaatggatgatgaggtggtatgattgtatgttgcgttttagaattagtgggttataactttacagtaagatatgataaagttgagcttgtttagtggttcaggtattgggccattgaggtagttgttggacaagtccaacacatctacaggtttttgatattacagtgggatctctccttgtaatttgtttagagccgaaatcaggacgagtaattaagagcttttagctcatcaatatctttcggaatcaccgtagtaaagttattgggccgtaaatcggaaatgggccaatcaccggctctcctcatagcccaagcagcctagcatgaagcctacatggcccaataaaggtatgtcagcggcccacagcccacccacagcacggtctgtaatgaagccccaggcgatctgacttctaagagatactccctccatattcataaagaaagtcgtttaggacaatgtttaagtcaaaccttgggaatataaattatgaataactctcaagttattgagtttgaaaatgtaaaaaatatatgaatagatttgtcttgaaaaatactttcataaaagtatacatatatcacttttcaataaatatttttatagaaataataagttaaagttgtgttttggagaccgtgtcgctatcctaaacaactttctttatgattatggagggaatatttaactattcgccatatttagatgtgacaattaactatttaccactgaatccatatatcatagacacatgtgaacctacatgtcattgagataggtgtgacaaatagttaattttcaaatctaatggtgtgtttggttggacttttcaacctgtttttgcttttgaaaaagtcaaaagccaaccaaaaagtacaaaagccagttttttgatacagtataaatcaaaagtggcaaatagccccgacttctgaggttctgaccatctatgtcgctctcgccctcgctctcgccaccgccgaacggcggccacgcgcacgtacgcgccggcgcggcggtggttcgtcggcgtacgcgctgagcagtgcaggagatcggatcggcacaggaaccgactccatgaggccgtgggcgatgctccagaggtaaaccaatgctgcaaagttcttgtgaaagggaaggccaatgatagcagtagctgctcgattgattgattcataccccattgtaccacagatttgggattgtgcctatgtgagatttggttgtgtctaagttgtttgtagctctgtagttctgcgtagatttctgatatttttcactgcagtgttgttggttgcagatttgttgtctcctcgtggcaaattgcgaacaaaaaaaatatcgaaatatttagtataaaatatctcgatgaacgttcacattcacattcgcacacaatattgacactaatttcaattcacttcactacttcagttcagattgtttacatgtgttcatcgactgttcggccatatcagttctctatttctaccttttggagcagactgaactgactgaatttctctaacagatcacggtctcaccaatcaggtttggttggggtgttcatttttctgtggctggagcggatgtcttggctctgctgaattgagaaacactcaagatcactacacatctgaagatgattatacatatttttttagataatggattaaactggcatctacacccaaaaaggatgtacacagcctgaagatgattatacatatatagagccagcgcacagtgttaactggttcagccaaaatatctggatatgattatctgatcatatagcacacctactccaaataacaaaccaagtgcaactgcaaagacgaccttgtcaatatactgctttgtggagataatggagactggagatgcttctgctgaattgcagtgggtgcaaaagcacagggctgcatagctttgggttcctataactgtcctataactggcacaggcccttcaaggtcattgtaagaaatgttgaattcagaaaggaagtgaaggtttgccagtgatgaagggattgctcctgtcagatggttgtaagacaggtctaacaccattagattcttgagattgctgaccaatacacatgtagtattcatgcatgcacgatcgtctcggacaaaggcacaattacattagccataatatctggacaagactagctggtcatacaacactccaattccaaagaacacaccaaaggcaattgcggagattgttttgctgctgcattgttgatcttcagagatagttgggatggtgtgagctacctctactgaaccacaaggagccaacatagatccacatagctttggattcccggcaaaactggagcttgagaacgtgttcatctggcctcctgtcggaataggtccttccagatcattgtcagaaatgttgaactttgagagaaagttgagcttgtttagtgcttcaggtattgggccagtgaggtagtttctggacaagtccagcacctgcaagtttgtgagattgcagatagatggtgggatctctccttgtaattggttagagctgaaatcaagatgagtaagagctttcagctcaccaatcttgggtggaatcacactggtaaagctgttagcactaagattcaagagtgcagggaaagatgtgactgcacggtattgtcgcgatagagtggttacatacacaggtagatcaaatagtattgttcgatgagctttgtaatcatctgattttagcatgggtatctctatcaaggtggctggtatttgtcctgtaaggctgttgtttgatacatccaaatagaagaggttgttgaaggagttgagccaactcggcattggcccagtaagttgattgttggataaatctagtacctccaaattttttagctttgatagccaaagaggtatgtttccgatcaatgagcaacgataaattgagagatgtcgaatactctctaaactttcaattgtctcatcttgtggtataacctcaccccagaaattctccccaataaacagggtagtgaggttccgggagctcttgaaagcatggagtgtctttgcaatatcactgaaagagttttcagtaattgacaggaaagaaaggtacttgagatcacctatttttgatgagatctcaccatgaatttggttggacgatagccgcagcgcagtcaaattgttgcatgagtatatgctttctggtattacaccactgaagtcattatgcaggagatccagggctctcagattgtgtagggaagagaagtcaacactgccaaggtctccactgaagctgttcatcttcagatcaatggttgtgagacgtgtgcagtttccgagactcgatggtagatttcctgacatgttgttgttgctcaacctaatcacttccagcttcttgagctgaccaatggactccgggatctcaccatgtaaattgttggtcgagatgttgagcacctgcaactgcagaggatgcttcaagccagtcatcaacattggcaatggcggtagcactccgtcgaggctgttgaagctgacgtcgagaacaaccagactcgcagagtacatgagctccggtggaaggctaccggagagagcattatgagagaggttgagacgtgtcaggctggtcagaccggcgagggacgacagtgagatgcttccatggagtcctcgagactgcagggaaacctcggtgaccgtgccttcgtcgtcacagacgacgccctcccaggcgtggcagcaatcgacgtccggtcgccacgacgcagcgaggccgccgtcgtgtgacagcccggcgaggaagcggaggagggagctcctgtcctcctctgtgcaggagctggccggagaagcaaagagtatcagcacaagaagaaggcaaaggaaatgagtgcaaaacctgctggatgatctgttgctgtaggaagaatgaagtattattggattgttcatggtcagtatctgaattaagctggtttggaaactgatgtgctggtagtagtagtagtagtgagcttgatttatgccgaaccacacggttcctgagcattatattatattgtcgaagcatcgaagagttatataatctggtggtgtgttgacctgtgagttcactttgctgctaccctacctaagctcactactatctgcttggtgccatgcttgtgttttggaagttcagtccaactattgccgttttctcttaccaatcttgtgttttggctcatgatgcttgacaggagagcttccacttaaattggatttttcctcgtacagctagatggctacttgattagaatttgttaaattctccattcgtttactcagagtcatagtccaggtctttggccactactgatttccttttatattcttttttttcccgctctagagggagatatggcgtacactttgtgcttgtgatcttttatcacttcaagcagctgcattttgaatccgtcaccaataactcacttgtgacttttgactgctcttggcttgtaataatcatttgcagcaatcgaaacatcaacctacattggttacatacttctttttaaaaaaacttgaaatggtttggctacactgctaaaagtttaactgatgcaggttacatgtttgtgtgctgctgctggtggtggaatgcgtttgcacttgcatggttgaacaaaatttgatcaacccttcaagtttcaagtaacatttgtaaaggttgatcaagccttaagtttcaagaaaaggttgtgttgtttgctttccaaatccaatcctttacaaagcctgtactcctgtactgctatagtgctgtccactagtagtatattgctttcatttatttttcagttcaaattcttgcgattgttgcttctatgaaatttcataaaagtttgtgtgaaatttctatgtcacagacagctcttggattcgcatgttccagatttactatgtctaaagtctgatattatctcagatcgcttcggctctcgttccgggtttgtattttataatttcagatcactacaaatgtgcgcagtccaaaaaaaaaaaggagacgtggcaaactgctagctaggtttgtaatggtggaattaacttgctcgggttcaagtcttagacttgatatggatactaatatttgccgctaaatattctttcagttgacaagagtaagttgcccgggatgattttgtcagtctcaaattatgctaactcaatttttcgaagattctcatagatattataagtgtgtatatatgtttattagtttatagaggtgaatatgcacgtatgtatatatatatatgtatgtgtttatatttttttttagaaaaaagtagaggcatgtatgagaaatctatcatattaatatgctacgacccggcataaggcatatcttgacgttttgatattcagttcctcgatcggaactatgattccatagtgaaattattttagggattcttttaaacgcatgaattttatttaatttatagtgataaagttatggggtatataatttcacctaccaaaatttaaatagttatgacaaagaataatacgcacgcacgaatattgtatattgtcgatgcatcgaagatttacaagttgatggagtgttgacctatgagtttactttccgctatctccctagtcacttggtgctattcctagggtttttcctctctcatttcctttttgccgacatgatgtgagtcccagattgtttgacattataccctaattaaaaaaaatattgtttgacattgacaacgcttattggaccaagtaaatttcctcaccatacacctggcctcttgaaacacgcttttatattataacacggcttgttaaattctggtttcttttaccatgattgtgacgtacactgccggcccgctgctaataatctcattactctctctatcatttgcattttcgtaatctaccctaacaatccatttgctctaattgcattacttttttttctctcttgagagatggttggttgggttactgaaagagtaaactgaagcaggtatataacatgtttgcgtgcatggttgggctactgaaattcgtttgcgtttgcatggttgaacaaactttgtgccttcaagttttcatatatatcccttcgttgttttctacgaaatttcaataaagttggtgtgaaaattctatgttacagtcttgtatatgcatattccagaattactctgtctaaagcatgtcagattccgtgctttgttccggatctgtatttttatacccttccttcagtctttcaggcaactactagagaaagtacttatataagcaggcttggaaaattgtcacataaaacttatatttagatggtgtcatggtgaagagaatagagtgaataattaagggcaccaaatttatagctagctataggggaagacactgtgtaaatgagagatggattgggtattaatgatgtaggagtagtatatatttataagtaactattccatagtaaactattagactctatttggaggaatataatattctaataagcagccggttaatatccagtttctgagaatttagatagctaaaactcaaattttaactttttattcattttctagattttacaattataaattcttagaatctggcttagattctacaactattagagcaaggttaatagtgtcgcccattgcttactcttgtagtcttccatcttagttatagacgtcaatgcaataatttcttcatcagctatttgttgatgcgaaaaacctaaatttggtcgttaacgctattgtacgacacattctccaatacaaagcatactttattcccctttctctccaagttgttcacctttctctttcttctttcacttgctagtgttttcaccatgagcttagcttctagctagcaacaaattaaaacattgcaatagaactcttgcataccgagcgtggtacagctaagctggagatgacgcggccgagctcgagagcctccttcgatgccgtcgtcgagctcgacagcgagtgggctgagctggttgtttctatgctcaagagcacctcctccaatgttgttgccatggaccttcgcgcttctctcccctccatggttggcctaatcttcaagtgatcgtccgcacgtttgatcgcacaggaccacgtggcgtcagcatgcctgctgatgacacctaagttttttagagcctgtgtatagtcggcgactatttagtcgcctgtttgctctctctctctctctctcatcccgcctttcttctccaaatcatcgaaaaaaacaacgtggcacacatatcgttggctaatatcgttctattatatttgctcttaattgtttggggagttgaaactttagagaaaaaccacatctgctatgtattttcttagctcgactctctaaccgtactattaccaatgctaacgaattggtagttttcattttggcccttctttcatcatcgcgatttttgtttacggccaggaagttttacaacgtagcccctgtattagcgtggcactccgtttccctcctctccgcctgagccgccgccaccttctccccaaccatggagtccatgagttgggcaagcgagagcatccggcgaagcgagaggacggcgccgcggcgatcgaggagcggaaacctcgaggtgaggttagccatgtctctttccctccttgattcgagccgcggcgccaggaagcgggaggaatcaaaaccccccgtagccggccggtgaacaatcgcgtcgctgttctctctgcagccgcctcctcttgattagattgatttgctgatgtagattctacaaaggtctagttagaaggaaggattgcgtagagtagccgcttcatgtcagatttgggatgtggcgcggcatgagttttttttgtctgcaacgatttatgacattttctcaattcagtattgctgtttcactagttgcagattgtgatcccctcacagcaaattgcagagatagttgttggaatatagccacaaattaatacaagaacgtttacattcatgtgtaatattgtcaagatttatgtactggcaggtttcagtttacttcagttccttctgattttctactttggagcagactgtattaactgaattttacgaacatatcacgagctggtcaaatcagcttttcctgggtattcaactattcatcctgatgggggtggaaccactcgagatcaccacacagttaagacggttatagtaatcacaaagtcgcagctgttgctttgcttgtttcatttctatggcccattccatatctacaagccattaatccagtacatgttattgactttctctatcgtaatcggtttaaccgaaaatatctagatacaactatctgatcatatagcactccaattccaaagaatacacaaaaagcaatcacagggatgaccttgttgatgtaatctttttttgagcttgggggagacaaatctgcttctgctacattgcaacggtgcaaaagcatcgggctgcatagctctgggtttccagcaaaactagaacttggaaatgtgctgaactggcctccaattggtacagacccttttagatcattgtaggaaacattgaattcagaaaggaagtgaaggttcaccagtgctggagggattgcacctgtcagatggttgtatgacaggtctagaaccatcagattcttgaggttgctgatcgattgtgggatctccctgtttaggttgttgaagctcaagtcgagtgaaacgagtgctttcaactcaccaatctccatcgggatcacaccagtgaatttgttattacctagattcaacattttagggaaagcagtaactatacggtactgaaaacacagacatgcgcctgcatacactggaaacggaaaggctcttgggtctgagtgtagaaggagatttggatcaaccgtaactttcattgatcaatggagcttatatttatacatgtacaacaaggcttgggagttgcctgggcctaactaatcccctgatctaagggacgtgcagcggtgcgagcggagcgaggagcgcggcgtcgtgcgcggggtgcgcgtcgtgcgcgtggagcgcgcctcgagagtctgacgaagccgttcgccaacacccccccgcagtcgcagccgtcgtatcaccgacgcagagactggctcggaactcgttgaacatgcttgaaggaagcccttttgtgaacacatccgcgaactgatgggcactcggtatcggtaggacgcggagttcaccgagcgcgaccttctccctgacgaagtggatgtcgagctcgatgtgtttggtccgcttgtggtgcaccggattcttggacatgtagacgctggagatgttgtcacagtaagcgatcgtcgcctgtggaacgcggcagtggagttcaccgagcagctggcgcaaccaagtgcactccgccaccgcgttcgccacacctctgtactcggcttccgcacttgacctcgagacggtcgtctgccgcttggacgaccaggagatgagggagtcgccgaggaagatgcaaaagccggacgtggaacgccgggtgtcggggcagccggcccaatctgcgtcgctgaaggcggtgagcgtcggcgacgtcgaggcgcgaaggtgtaagccaaacgcggccgttcccttgatgtagcgcaggatccgcttcagcagggtgacgtgagcttcgcgcggagcatgcatgtgcaagcacacctgctggacggcgtaggcgatgtcgggccgcgtcaaggtcaggtactggagagcgccggcaatgctgcggtaccaggaggagtcctggaagagaggcccctcgtcgcttgacagcttgggtttagcgtccgccggagtgtccacggccttgcagttcgccatgcctgcacgttcgaggacatcggtggcgtacttggactggctgaggacgaacccgtcggcagtgcgctgaacttcgatgccgaggaagtacttcaggggccccatgtccttgaccttgaactccgcttgaaggcgatcgatgatgcgctgcagcaagctcgacgaggacgcggagaggatcatgtcgtcgacgtagaggaggaggtaggccgtgtcggagccacggcgcagcacgaacagggaggggtcggcgcgggactggacgaagccgaggctggttgcatgatcggcgaagcgcttgaaccaagcgcgcggggcttgacgaagaccgtacagcgaacgggagaggaggcacacgtccgccgggcgagcagcatcctcaaagcctgtgggctgctggcacaggacacgttcctgaagatggccgtgcaggaacgcgtttgaaacgtccagttgatgcgccggccattgcttggaggaaatcagcgtcagcacggtgcgaatggtcgctggtttgacgacgggcgagaatgtctcgccaaagtcgacgcccgggcgctggttaaacccgcgaaccacccaacgtgccttgtacttgtcgagtgagccgtcagcatgaagcttggtcttgaagacccacttgccggtgatgatccgagcaccgggaggccggggaaccagagtccacgtcctgttcgcgagcagggcgtcgaactcagcctgcatcgccgcgcgccagttgggatcccggagcgccgcgcgaacagacgaaggtgtcggcgacagggtcgacgtggcagtcatggcgtaccgcgggttgggtttgctgatcccagcccgcgcacgcgtcgtcatggcgtgtcgaggtggagaggcggacgctggcgacgacgtctcgggtgatggaggcggcgcgacgtcgtgggccggagcagcactgctgggcgtggacgacgcgggcgacggaggcgatgcggcgtcgtgagctggggcggtgccgacaggtgtgacgacgtgctgtgctggagcaggcagcagcacaatagtgtcatcgccgtggtccggtggcggaggagctgacgggcgaggcgatggcacgtcgcggaaggggaacacgtcctcgacgaacgtgacgtggcgcgacgtgaacacccggcgggagaccatgtcgtagcagcgatagccacgatggtcagccgggtagccgatgaagacgcacgccagggatcgcgggctgagcttgtgcggcgctgtcgcgatggtgttggggtagcagaggcagccgaacacgcgaagatgatcgtacgtcgggggagcgccgagcagcagctggtacggcgtgagggagcccgtggcgcggcatggccgtcggttgatcagatgcgtcgccgtctgcaaggcttcagcccaaaaagacaaaggagcagcgctgtgaacaagcattgtgcgcacgcagtcattgatcgtccggaggatacgttccgccttgccattctgttgagaggaataggggcaggagaggcgaagaacagctccgtggagagacaggagtgagcgaagtgcataagaatcgtattccttgccattgtcagtttgcagagctaaaacggggagcccgaactgtgtgtgtgcataagcaaagaaggaacgaacagtatgaaacacctcagatttattgcgaacaggaaaggtccaaatatagtgtgtaaaatcatcaagaaataccacataatacttgtaaccggaattgctataaatgggagaggtccaaacatctgtatgcactaactgaaagggaaatagagtctgactagatgaagagtggaaaggaagccgcacattcttgcctacatgacaagcagaacagtgatggggggctgatttattacattggaaatcaaaggaaccaagaaccttggacagggaagcagagccagggtgcccgagccgcagatgccaatgctccaccgacggcgaggaagtcgcagagagggcgtgtggcgatggcagacgcagggggtacaggtcacccgggctgtcacagcggagcttcaccacctgagtttgaagatccttgatggagaaaccagttggatcaaattcaatggagacattattatcacgagttagctttttcacagagatcaaattcttaatcaagggaggagaaacaagcacgttatgaaggtgtagatcagtggaggatgtgggaatgtgggtggaagctgtatgcgtgacaggcagcttggcaccattgccgacagtgatacaagaggagaaaggaagaggacggggatgagcaagaataccaggggtggaggacatatgtgctgacgcaccggtgtcgaggaaccaatccgcagcgctcggaggagtggtggtggcgacgccggcggactgcaaggcgctgtagagcgcactgttgtcccaggcgccggtggattgaactcctggagatgccggaggaagagccggaagcaggtgctgcgcggtcatggcctgttgggcctggaacggcgggcgagggcccaacacacccgcgccgggagcccggaacgggaaaggccaggcctggacaaagcctgtccaggggttgtagccccaaggcgcaggagggcgaggctggccgtcgtgcccggcaccagcgccgccgccaggagtcgaaggagcgccgccaggtggggcgccgccgccccggccacgacgcttgccccgtcccttgggacgaggctggccggtggtgtcggaggtgccggaggaagacccggtgccggcgtagagggcctccccggcttcagccttggcgtcgtgctgcatctggagctccgccagcagcaggtaggagcgcgcggtcatgaaagtgtgtggcggattccggtcggcgaagctggcgcggagggagcggaacttggtgttgaggccgcgcaggaggttgagcacctggctgggctcagacacgggcatgttgatgtcgcggaggccgtcggcgagttgcttcagcttggcggtgtactgcgtgatggtcatgtcaccttgattgatcgagcggaactcggtctcaaggtagacagaccgttggacggcgttgtcacggaagacgccttcgatgtcgctccacacggtgaaggcagaggcgcggggcttgtagacgacgtcgaagacgttcttggcgatggagttgtgcagccaattgaccacgcagtgatccgcacggcgccactcggcagtgcggaggtcgagagcgggcggctcctgaacatgggcctcaaggccgaacttgccgaggaccgattcgaagctgtagcgccactggctgtagttggagacgtcgagatcgaggacgaccgggacgtgggagcggatgttgacggtttgaagaacagaggtggaaggcgccggcacaggctcttcgtcagaggtggacgaggcgtcggaagcgccggagctgtgcgacatggctagcaagggagaggtagcggaagactaagatcagagggtcactgataccatgtagaaggagatttggatcaaccgtaactttcattgatcaatggagcttatatttatacatgtacaacaaggcttgggagttgcctgggcctaactaatcccctgatctaagggacgtgcagcggtgcgagcggagcgaggagcgcggcgtcgtgcgcggggtgcgcgtcgtgcgcgtggagcgcgccgcgagagtctgacgaagccgttcgccaacactgagttatctgcaatcttatctgattttagcattggtatctccattagtgcttgtggtatttctcctgaaaggctattattggatatgtctacatacttaaggaagtttaggctattgatccaggttggtataggtccactgagttaattgttggataaatctaaaactgccaaatttccgagctttgagagccaactaggtatttttccagtcaatgcacaatcatgtatgctaataccaaaaatattctcgaaaccatcaattgtttcatcctgtggcatagcttcgtgcatgaagttgcccccaattaacaagacattgaggttccttaagctcttgagtatgtgaagagtatttttgatatctgtaaaattgttgtaggaaagagataagaaggtgatagaattcagattccgtatgttttttgtcaactggccgtgaagcctattggaagatagccgcaaccaagtcaaattactacatgagtatatgctttctggaattgtgccggtgaagtgattcgaggcaaaatctaatgttttcagattgggtagattggagtagttaaccttggcaagctcacccgtcaacttgtttctcctgaggttgatggttactagatttgtgcaatctcccaatgatgatggcagctctccagataagttgttgctgcaaatgtgaagctcctctagtcttttcaactagcctatagaatttgggatcttgccactgaatctattccatcgaagatcaacaaaaacaagattgatgagctttacgatgagagcatcatcaattgttccttgcaacccattgttagcgaaagagaggtactccaatgatgtggcattgaagagatcacctgggagaggccctctgatgttgttggcattagccttgagaagtctaagggcagaacatttacctattccaggggggatgttgccactgaactggttgtacccaagatcaagaacagcaaaagatgtcgagctgctgcagaaggaggaaggtatgtgccctgtaaaactgttgttgctcgcgttgattgcgaccaggttcctcattttctcccatgtgatggatggaaactctcctgtaaaccggttgcttgagatattcagtaccttcagtggctggttagatactgatggattcaactcttgcaggtccccgttgaggcgattgaagctgacatcaaggacgacgatgctgccagaggacatcaactctgctggaaggctaccagatagggagttgtacgacaggttgaggcgcgacaagctggtgagctctcccagtgacggtgagatttgcccttcgaggccttttgaggctagatgtacctcaattacagccccatcttcgttgcaggtgatgccttcccacaacagcagtccatgccattctgccatgacatggcgatgccaccgtcttgcgacagctcagcaatgaaccggaggagggagctcttctcctgctcgacgcaagccatggcggaggtggccacgatgagaagcagcagtagcgaggccattgaaaggcatgactagcctgcttctccacggagaatgctgtgccatctgcatgatctctctcatcggagctgcgtttggagttatatgtggcaatctggaagctaaaatgttcgcgaaaacgacactgtttcaggataataatgcacatggctgctttcttgatctattgcgtttgagtctttctatcacattgtttatctttattgttttcattctatcactggtagtgatgtgactcattctatcacattgtttatctttattgttttcattctcgtttcagtttatatatatagtagaggtccccgccttcccggtttgagtttttgttcctagttctctgtcgttttactctgaaatttcaacaattttgtgtgaaatgtttcatgttaagaactcagattccgtttgtggtcgattccagtctaattcagttgtgtattaaattaccacatctgcttgcgctggcaattcatgtttgcaacgtgcattgctactttgtacaattgcatcccttatattaagttcgaatttgtgcttacattaactttgcgttttcacttacctttcactttcaacttttgcctctgaataattttgttcacttgttcggctagttgtctcgtatgaactggaactggcagaattttaacattgagatgattgaaatctgtggtttgttcggagagaacgctgtggtcacgcggcctcttcaccacgccgccaggctgggaccgcggccgccgtcgatctccactctttagccaccgcctgggcgtctctggccaccgcctgagcatcttcgcaccgactagataagagataagtaaagtggagatactcgctaggtcccatatcgtcttttgtcacgttgacgtgtcgcatgagcaaaagtagcaagcactatctccatttcatgttataagtcactttatttttttttctaattcatttttttagtttgattaagtttatagaaaaatacatcaatatttttatataaaaataaagaaattaccaaaatatattcaatgttgtattcaataaaactaatttagtgctatagttgttatatttttctataaacttttaagaaattagagtttaaaaaatcaaacgacttataatactccctccgtccctaaatataagggattttgggtggatgggacgtatcctggtactacgaacctggagatgctcctatctagattcgtagtactgggatacgtcatatccaaccaaaatcccttatatttacggacggagggagtatggaacagaggaaataattaaaaagttatctattaagaggggaaaataggatcaaatctaaaaatagcatttgaataattagtggtaaataattaagtctccccaaagattggttgtagtcttgtagagaccatgccagattgccaggatgccgatggatgccgggccgtgcgctctagctcccggagatttggccggccctccctcggaaacggaaacagtaaaaaaaaatacgaatgatatcggaaatagtttgatagtttactaaccattttattcggctaccatattattccggtaattagggatgaaaacagtcagaaatgatcggaaatggtacattattttattttattttttgaaaatgaacggaaatggtcgggaaattttgatatttatgaattcatctatttagtgccaacttcaatgccacgctgacagaaattaaaaaactaaattttgaaaacggtaaccatcggtaaaaatattattattatactagttttacggaaacggtatcgatatggtcgggaaatttccataccgttttcacccctaccggtaattgctgtttatatattatatggtaaattacagtttttacaaacatccttgaccggctggcccaaattatttttctatggcccattctttcagcccaactatcctagtccaccactataactcatgtttgtgtatctcgtattgttatgttatagctttatgaacttacacttatatgtcaatggatttatatttatcatcgaatactttaacattatcggttatcaatttgtcataaaaaaatcacaaatcacaaattctaaaaagaaattgcacatctcaatggaatcacaaattgtaaaaaaaaaaaaaaaaagaatcggccgctggccgcctgccgccgtcggtcacggccccgctagccggccgcctgcccgccgctgcgcatgggcccgcctgtcgctgccggtcgtggccccgccggtgggccgcctgcccgccaccgcgcgtgggcccgcctgctgccgccggccgccgctgttgccatgacacgcacagatgggaggggagaagggggaggagaggggaggaggacgaggaggggaggaggaggaggaaagggatctggatctggatctgaggggatgattcaatcttatatctagctacgtatctcggtgaggagtccgttgggacttaaccgatcggatcgacgattgtgggagagagatatttacttccggttgataactccaatcgggactaaagatggatttttagttctgatctctgccgccttgacatcctctgacacaactagaaccaggactattgtgaattttggacaacccggcaaagatcacttctccaatagtgatatcggatggctatgatttcttaccgatgtttctacaaatatccaagagagaaagcagggtacatggcagtaaggggcaatccaaaggagtcctaggagctgtatatcaaattcaattctatattgtttgtatgatacgactgtaattatgaaaaatcgaagctacaagttctacatcaagttctattctgctttaaaaatctagctccgtgtaaaattgtatgggacggtcgaaaatagcagaaaaaaaaaaggaatgacaccaaatttcaaaaccaataaatacagagtacgtaggtagtctagatgaacctgggaggagatacgtgttgtatttgtaagtttgagttggtcgaaaggaaacacatttgatagatcttgttcgacggaaatcctaattaattataacgctcttgactgacggtcacggtcgcgcttaacgttatcagtataaacgaattcctataaaaaaataggaagtttaatcattagctataccagccagttgaaagtttcattaatttcggcgtgttgaattgaaaattcagtaatagtaggaagtttccaatattgatcattttcttgaatgaaaagctagcttcttaaagaaagttttagtctaagtacacatagttgaattttttttttgatattacacatagttgaattagtatatatagaagcacactgacaaaaacgagacgtacagaaaatccgagaaaatctttaaggtgtgtttagtttcacgttaaaattgaaagtttgaagaaaaaagttgaaagtttacgtatgtagaaaaattttgatgtgatggaaaaattgaaagtttgaagaaaaatttaggaactaaacaagcggtaagctatgaagaaatttggccactaaaaaacaattcaagggggctggttttttgcaacgcgctcgcggaagatgtctccgcggatgtttgcgtgctaattaattaagtatattaaggttgacggacccggtacgtatatgcgtgttcgtacgtttgctatatatatacggccacacaggcgaagctatatatattcactgcatatatccgtacgtacacaagaccactgcaatcacaccaccacaaggtcccaataaccctagctagccagcctgcatttcgatcaagctattcaattcgcacaaggccaatcgatcgatcgatcatagtcctagtttctgcatgatgatgatgcagctcctcctagtgatcatcatattgtccacagtgatgatctcctcgtccgatgcttattatcaatcatgcagatgcttgggtgatggcaagaacaaccagacttcctgtgatcaagcgatcgacgactccatcaaaggttcaggtccgtctttttttgcagcaaaattctctctccaaccaaaccagtagtacactcattggggcaaccctttgcagggcagctaatttttcgacgcatacagccgccgatcactagcgtcgcctttaatgtgagcttcatcggaagcctcgccttcatcctccgcccagtcccagctggaggagaatatagcaataatagcgatgcctatggctccctcgtgttctccggcaacacttataataaaacgacgacgattattactcattctgactgctgcagcactggcgacagtagttccaacgtttttgttaagatgggtgcattaaaaaatgtttctacctttggtgtaaacattacaatctcacggaaggcctccaatattcaaatagtacaagggaacaactacaccatatctgtatggattgattacaatcgtgcagctgaagctgcagatcgcagcatatcggtcttcgttgccaaggcaagagagacgaaacctaaggaagccataatcgtcaacaaggacgacaatatcagcaaaggcgcaaccctgcaaggctgcatcttctcgtcgatggacctgcaacgactccatcagatcagtgacatggatgtgacattcgcctatggccaacatgttagccatagcccatcgaggtcgttgccgaccatactggcatcagttctcggaccagcaggcggtgcagtcattgctgcagctgtgacatggttatacttcaactcctcctacaggaggtggaagaaggacttcgatcagctggccaagtccatgcaaagcctccccggggttcctgtcaagatcagcttcgccgatatccgcaaggccaccaacaacttccatgacaccatgaagctgggcagcggcgcatttggcgccgtctacagatgcaagctccagtccttgaacttgaaggagcaaccggtggaggtagcagtcaagaagtttacacgtgccgacacccggtcctaccaagactttctcgccgaggtcagcatcatcaatcgtctgcgccacaagagtattgtccctctcatcagttagtctcctccaattcttgtacagtttaattttctatttgtcaatcgcctaatttttcatatttatcggtctcctaatctaaatttgcgatcctagctagctactccctccatttcataatataagactttctagcatatgtgtctagattcactaacatctatattaatgtggacaatgctagaaagttttacattatgaaacggaggaagtagttgttagttttgtcgttaaatatacgtttccatacatacatacatttcattttgtgacaacaagttgacacatataaattattatatataggttggtcatacaacaaaggagagcccctacttatctatgagtacatgcccaatggtagcttagacaggcacatattcgctagaactgaccagctgcatggtggccaccatacaacgatccggcaatgggacacccgctacaacattgtcagggatattgccaccggcttgcactacgttcatcacgagtatgagcccaaggtgctccaccgcgacatcaaggctagcaacatcctgcttgactccaccttccgtgcccgccttggtgactttggtctcgcctgcaccgtcgccgtcggccggagctccgtctcgtgtggtgtcgcaggaacattcggctacatcgccccggactacgcaattaacctgaaagcaacgcagcagactgacgtctatgcgtttggggtgctggttcttgagattgttactggcaagaaggcgatgctgaatgacgcacaatttggccatatcacagattgggtctggcatctccaccaacgggggaggctccttgaagctgtagatggcgtgcttggcactgccggccatggtgagttcgatatcgaagaggcaagacgcttgcttcttctaggcttggcgtgcagcaacccgaacccgtcggaccggccaacgatggtggtggcggtgcaggtgattgcaaaattagcaccggcaccggatgtgccacttgagaagccgactgttgtgtgctttcctcctctaactttgccagtagggtcttcatcatctgaatgcactgattattacgtcacggcaaagggtagtctgcagatcaagagctcaatggtatagacagctagcatgcatccccataggattgcaggtatatatgaattctgaaagcagctgagaatgtgagtgttgattgtatttgtattcagtaacttgctagttactttatctcgtccccttagatctgttttagcattgtgcagaaatatcattttgttatactcgctctgtttgtaaatttgtttggtgctccatggtgcccgggctccatgattcaaaacaagtttgaactgaatttaaacatgtttttattacaattttattctaggtatatagcatccaaacatataattagttaggtatgtaatattgaattgtaaaataaagttaaatttgagttgctttgttgctaggtatagatatgaatcgaatacttataactaggtatatactcacaatttaaaaattttgaaaaatttgggcgaatatgtgtatttcataccatagtgccctatatgagtgtcctatatatagtgtgtgtgtaaatctctactattataaaaattgataatgtttccgttggatctttagtacgttgttcgtatttaaaaaatacagtgtttctaccaaggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaaagaaaaaaatcaaaaaaaatagtgaaggtagtgcttgatttatagtgttttatggtgaagaaatttctcaaaaaagagtaatatttatttaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgccaaaccgcgcggtttgcccgaatttttgaattcaaatttcgatttgtaaatttgtcgcggttttgcgcggttaccgccggtaaccgccgtaccgccgggtggcggtaaccgggcccccggcggtttttgaaaccctgactttctaccctcctcagatttctatccgtctctcctaattttagtcagttttccacgcgttggctctgttcagatcgctctcccatgtgcgtgacacatgttggccctgttcaggtcgctcttccacgtgtgtgacattggattgatatgcgcttctgcgcgcatgacattagatcgacacttgttgtgtatgtttccaatcggttcgtttgcaacgcatagtttcatggttagccagacacgaccgcatcaacaaatacagcccaagtcctatgcaataacgattgtatagatcaaaggcaatatttctaaataaataataataatctcataaaaaccagaatatatttttatagtatctataaaatttccaatctttttaaatattagcaagcctttttaaattttatagatactttaaaatatattctagtttttatgagattattattatttatttagatatatatatatatagacacacactacacataggatgtagcatgcctaaaacacaccccacaatacaccagcccgcaccccccctccccaaccgcacagtgcggaccccccaccccccggggcggcgctcctcggatagtaattcgattactgtcaactgtacgtgttatttatactactcggtggcccaaccgtccctacttcttccccgcgctctccattattttcggatctagccctcgcgtacaccgtagttagccaagccgctccgcctcgtttccatcgccgccaccaccgcctccccgtccgcctgccgccgccgccgtgtgggaggggatgccagacttgggaggtgacggcgacgaagtagagaaggcgcccaccctctcccctgcggctgtggcttgtgctcggggatggatgcggcgacgggcgacggcgacggactgcggcaatggcgagcgacgggctcggcagggctgtcccccgctcgaatccggtgacgacggtcgtcctccgcccggatccagtggtggcgggcgtccctcgcctgacctcggacggatccaccggcggcggtgggaggaaagcagcgtgcggcaggccaccttgcagtcctctcctcctcttcctcctcccgcttcttcctgcccgctgccgtcatcatggttgtcctccaccagctctccgcgtggccgccgccgtccgccgatggacgtcgactctgacctggccgacaagggcaagcccacccagatggacctcgaggaccaggtacgccgaagccgctcgactcgtccccacaggaattcttctttcagttttttattgtgactgcctaagcttggagagcatctcaatttccgttgaaacacttcagggaagcatttagctctgagatttcatgagacttccatctattatcctaccaaacttctggctggttcgttagttctatgtgatctggatttggtttgtgtaacactaacatccattgatattctgaatttttcaggcttctatacatctacaggtttctgtaattgataggttaacaagcttttctaatttatttattttttggtgattgttgcttttgctggatcaagcatcatgagtgaatagtcctgatagccgagtttttttttttttttgcaacgcatgaagaaccatatgctctcattttaattttcatttgttcagtcatgaattgtttgtgcaatatattcagaaaagtgctcccatctgaatttcatttgttcagtgatatatttgtgtgtgcaatatttggaaaactgccaatagcatcatcatcaggttctctgatattttttataaatgaaaactctagaagcttgattcaatagcagttcactgaaattttgtggttcaacagagcatatcaattgattttctctgaactgctctctacatatgatccttttgatcatagtttttcgctgaatattttggttgaacaaagcagttgtagtcccctatgagcttttttctgctgtagatgtagttcatgttctgattttttttttgttgatgaacagatttctcaattttggtctacttgatttttcatccatagactacaggaatgctctgaatttgtggagttttctgcacctcagctgacgatcatgggggaggctgcaaccccagcgaggcaggaggatgttttccaggtggcgggtcacgcctcgtcgatagcatagatcacacatgggcagaggaagctgtggatagcatgatgggtctgctagctgcaaggttcgttgggttgcagctgagctatgcatttttttagctccttttatttttctcaagcaattatctttgtggttcaacaaagcagatcgatacatgttttcctcaactgctcaatgcatatggtccctttgattaggttcttgattttcttgtaaaaatgcgtacaacctgtcaatccattgaattttctgcaattttatggttcaacagagcatatggattcatttttctgaagcactcactgcatatggtcatgttgatatgggtcttgattttgttctacaattgtgtagaatctgtcgatccatcgaattctttttgatactgctcttgattttgtacagttcattgggtggagctttctcttggggggtgcttttgcctgccatggtaaggccagcaagatgggatgaggcttcagctggctagtggggatggagatgaaatcagaaatcaggatttactgtcttttgtagttaataatcagcgtcgtcggccctgatctacatttgctatattagtgctggcatcgatcggtatcggcatatgtattagcgggtggtgttgatttgattttgtttattagttttgtgtttttctgccgatgtatcattgcgtgcattatcagattgttgatgtaacaccgacactggatcaaacaattcatgtttgtaaagaaattattaaattgtggttaggttaataatatgaatcataatcttttaccttcatttgttttgtcactaaatactccagcggctttgtgcaatctgcaatatatttactccagtatcaggagtaacttattttactaagagaagtccaatgacgtgcaaatattaatttatttactaagagaagatttgcaaaccaattagagtactaatatactaagtaatttataattacttactaagagaagagctgagaacgatctgagagtaatttatttactgaaaggaggaatcttcccaaataatctaggagtaattcatttactaagagaagaaatcaatttggaagtgcggaagtgttagtaacttatttactcttaggccgaaagacacagtaatcttgttactaataggcaaatcaccaaaaaaagtgtttgatagtacttaacgaaagaattttttggagagagagggatgaggagtttgtgcgggatggatgtgcgtggggtgatgcgggggggggggggggggggggaaggggggtggggtgggtgggtgggtgggttggggggggggaggggtgctgaggggagcgttttagttgtaacgcaccctgggtgcggtttagcgcgtccctatagtggacagtgtgataataaaaaatatctttattttgttgctctatttacaaactaaacttagactttttttaacaactttaaaagaaatgtattgctaaaaatggcatcaattggaatatttagttcacgtcaaaattagaagtttgattgaaattggaactatgtgacggaaaagttggaagtttgtgtatgtagaaaagttctgatgtgatggaaaagttggaactaaaccaggcctcatattttaagaatgaggcctgatttagttctcaactttttcctcaaactttcaacttttccatcacattaaaacttttctacacacacaaacttccaacttttctgtcacaaacatttcaatttcaatcaaacttccaattttattgtgaactaaacacaccctgcgttagaatcaactatacattgttagagacaaatggagcttctagcaaaagctacatctgctagatataacgtgtcaattttctgagctcatctcattattaccaatgctaacgaattggtagttttcattttggtccttctttcatcatcgcgatttttgtctacgggcttacggccaggaattttacaacgtagcccctgtgttagcttggaactccgtctcccgccgctcgccgctccgccgccgccgtcgcccgttgctcgccgccgccggggggggggggggggtcctcgtcatggacctcatctccgccatacccaccgccaccttctaactaaccagcgggagctgccagcgaagcgagagggcggcgccgcggcgagcagcggaagcctcgaggttagccatgtcttcttccccctcctgatttgcgccgtggccaggaagagggaaatccccccgaatcgaaacccccgcagtcggccgatgagcagctcgcgcaaatcaatcgcgtcgttgtttctctctgcagctgcctcgtagaaggaaggaaaggattgtgcagagtagctgcttgatcggttcatgtcagatttgggatgtggctgcatgagttttttctgctacgatttctgacatttctcaatgcagtgttgctgtttcaccagttgcagatttgtgatcccctcatggcacattgcagagaaaattgttgaaaagtaataagagtatgtttacattcacgtgtaatattgtcaagattcatttactaacgtatttcaagtttacatcagttcacttctgttccttctgattttctactttctggagcagactatattaaatggattttaccaacagatcacgagctggtcaaatcaggtttgcctggggtattcatcctgctggggctggagccactgaatcggccttgctgaattgaaatttgaaaaccaatcaagatcaccacacagttaagatggttatagtaattacaaagtcgcggctgttgcttgcttgtttcagttctatgacccattgcatatctacaagccattaatccagtacacgttattgactatctctatcgtgatcagttcaaccgaaaatatctggatagaactatctgatcatatagcactcctactccaaagaatacacaaaaagcaatcacaaagatgaccttgttgatgtactcttttgttgagtttggggaagacaaatctacttctgctacattgcaacggtgcaaaagtatcgggctgcatagctctgggtttccagcaaaactagaacttggaaatgtgctgaactggcctccaattggtacagacccttttagatcattgtgggaaacattgaattcagaaaggaagtgaaggttcaccagtgctggagggattgcacctgtcagatggttgtatgacaggtctagaaccatcagattcttgaggttgctgatcgattgtgggatctccctgtttaggttgttgaagctcaagttgagtgaaacgagtgctttcaactcaccaatctccatcgggatcgcaccagtgaatttgttattacctagattcaacattttagggaaagcagtaactgtacggtactgaaaacacagacatgcgcctgcatacactggaaacggaaaggctcttgggtctgagttatctgcaatcttatctgattttagcattggtatctccattagtgcttgtggtatttctcctgaaaggctattattggatatgtctgcatacttaaggaagtttaggctattgatccaggttggtataggtcccctgagtttattgttggataaatctaaaactgccaaatttccgagctttgagagccaactaggtatttttccagtcaatgcacaatcatgtatgctaataccaaaaatattctcgaaaccatcaattgtttcatcctgtggcatagcttcgtgcatgaagttgcccccaattaacaagacattgaggttccttaagctcttgagtatgtgaagagtatttttgatatttgtaaaattgttgtaggaaagagataagaaggtgatagaattcagattctgtatgttctttgtcaactggccgtgaagcctattggaagatagccgcaaccaagtcaaattactacatgagtatatgctttctggaattttgccggtgaagtgattcgaggcaaaatctaatgttttcagattgggtagattggagtagttaaccttggcaagctcacccgtcaacttgtttcccctgaggttgatggttactagttttgtgcaatctcccaatgatgatggcagctctccagataagttgttgctgcaaatgtgaagctcctttagtcttttcaactggcctatagaatttgggatcttgccactgaatctattccatccaagatcaacaaaaacaagattgatgagctttacgatgagagcatcatcaattgttccttgcaatccattgttagcgaaagagaggtactccaatgatgtggcattgaagagatcacctgggagaggccctctgatgttgttggcattagccttgagaagtctaagggcagaacatttacctattccaggggggatgttgccactgaactggttgtacccaagatcaagaacagcaaaagatggcgaattgctgcagaaggaggaaggtatgtgcccggtaaaactgttgttgctcgcgttgattgcgaccaggttcctcattttctcccatgtgatggatggaaattctcctgtaaaccggttgcttgagatattcagtacctgcagtggcctgtcagatactgatggattcaactcttgcaggtccccgttgaggcgattgaagctgacatcaaggacgacaatgctgccagaagacatcagctctgctggaaggccgccagatagggagttgtacgacaggttgaggcgcgacaagctggtgagctctcccagcgacggtgcgatttgcccttcaaggcctttagaggtgagacgaacctcaatgacagccccatcttcattgcaggtgatgccctcccacacacagcagttcgtgccattctgccatgacatggcgatgccaccgtcatgcgacagctcagcaaggaactggaggagagaactcttctcctgctcgacgcaagccatggcggaggtggccacgatgagaagcagcagcaataatgcagcagtagcgaggccagagtacggcatcgctagcctgcttctccacggagaatgtggtgtcatctgcatgaactctctcatcccagcaagtgtttggagttgaatgtggcaatctggcagctaaaatgctcgcgaaaacggcactgtttcaggagcataatgcacatggttgccttgttgacctagcgcgtttgagtctttgcgactggcatatttgagtgtacgtggtagtgatgtgccataccgctggcgctatctatcacattttgtggcctattgactaaatgagacagctggagtactcatgggccacactgctattctatcacactatttccgtttattgttttattctcgtttcagtttgtatagtagaggtccccgtcttcccagtttgtatagttctctgtcgttttactctgaaatttcaacgatttagtgtgaaatgtttcatgctaagaacgcaggttccgtctgatgtcgattccagtctagttcacatctgcttgcgatggcaatttatgtttgcaatgtgcattgctactttgcacaattgcatcccttatgttaagttcgaatttgtgcttagattaaccctgcgttttcacttaccttttcactttcaactttggcctctgaatattagtatataatcaattgttcggttagttgtctcgtatgaactggagcagcagaattttaacattgagatgattgaaatctgtggtttgttcggagaggacgctgtggtccctgtcagtcttcaccgcgcccccaggctgtgaccgctgcggccgtcgatctccactctagccagggaggaagagaccggtggagactggagagactcactaggtcccatatagttttttgtcacgttgatatatgtccatgagcaaaagtagcaaatactccactattttcgatttatgtaaatcactttgatttttttcaaagtcaaactttttagttcaattaagtttatagaaaaatataacaatatttttatataaaataaataaattaccaaaatatattcaatattgaatttaataaaactaatttaatgctatatttttctataaacttactcaaacttttaagaaaatagactttaaaaacttaaaacatgaaacacagaaaatagttaagaagtcatctattaagagggggaaaataagaccaaatctaaaaatggcatttgaataattacctttactaaaataattagagagtaaaatacatggccagttcttaaacttgagcagaggtgtcacattttgtgagttcggccaggggaaaaggctcgcctctggaagtcacgtatccgccccgaaagctaccagctagtgtgcacacaacaagattatacaggttcgggccgctatgaagtgtaataccctactcctgtgtatgggatttagactgaaagttacaaaggtccctaagctccagaaagcgctcttgcttcccttctcctagagcttaggttttctgagagtcgtcccttttctcggtgggcaaggtcctccttttatacctcaaggggataccacatgcaccgactctacctactcttctcttgggtgggggcccaccctaccttgaccggatctcgacccgtgccttcgcctggaagctaagccacggtttgtccttgagtggggcccagcgccgtcccatgcctgacacgggggacaaccctgtcattcccccattaatggatgaagaattgtggtggccgccctctcgtggggaggacttcgaatgacccctccgatgggacaggttatacctacctccactccgccaggggcagatgtgacgtgggggcacagctgtccgtccagtcagatgtgaccggcgacaggccggtcacagaccggtcattcctgaccgtcgcgcgccagtcgggcacgccgcacgtctgcccctactgcattgaatgcggcagggggcagttggggcgctgcgcgcattaaaggaggttcagcttgggccccctccccacttgctccccccgccagatggcggctgggcgaaggcctcggggcaaagcggtgcgagggcccgaggggcatgacgtggcaccccgaggcctcctggctgctcctgcgattcgcggggtgcgggggtagggccaagctgtagggtcgcgcggcaggatgggaaagtaaattcccctcacttcgcatacccccggtcccatatctccgacacacatagatccgtaaacttgatagttgcgcattgagatccatgatcttgttttaatacaccatagtcggtcaaaagtgcatttgaccaaaggtgaccatctacgtggcgctccacgcctccacgtaggtaacattttgcatcttgccccctccgcatcttgacatgacggtaattttgtacttacccccctattgctacagtaatcaccgaaatcccccaaatcttaatgagtgtcatgtactaaagcatcaaatcccccaaacttacttctagagttacctctctgactaacaattcttgtacatgtatgacaagagctctctagacgcttaacggcttaagtacttcagtaccatcaccgcaggatgaaaccgttgataattgattggtcaaaaactagcagtacaccatttctttgcgtggaaaaaagactagccgcagttttggcgtctccaaatgacacaattataatcaacctacacaatccacaatgccccatcgggacgttccagtagtggtctattggcaagtcaactgctcgatctccgttaccgtaagtaattctcttttgcagccgcccgtaatttttgaccttatcacattgacattgttacaacatgccttaatttacttgatcgggcatgacttctcttaccgccttcacgacggacctcttctcttcgcttgccattatttcggacaaagttttacttaaggtgttgaataaactaatgtataaaaggactaaaatactcttaagaggatattgtatagagaaaattccctatatacccctgacaatttactcaatcccttcaatacccctgaatttgacatcatcccttatatacccctgagttttcattttgatctcctctatacccatctccgttagttgacaattagttgaccgttaaatattttaaaatgactatattacccatcctatatatatgtggtacctacccaataaatattcatatgaaaaaattaacttatacaaaataaaagcaatataatcatttaatgcccaacttaaaaaataaaacttattattttttatttttaaaaaattatgattaaatccatacattagtttcaccagaaaattaagagcaaaaactaaatgttatttaggtttaaatttttgggaagatatacaaaattcatgaaatttgatcttaaatttatttaaaaattttaaatttgttttctaatttgtgataaactaattacatcccctttgttttttcacaatgaatcttttttcactaaatatttgttgaaaagtaattttcaaattttatgcagaactttttttacaataaatcttttttattttaatgaaataatgttttatttttaaaaattcataaaaaatatttagtaatttattccttattggttttcacaattcaaataatttacacataaaacatttctagcttttaacaatataccaaggacaataaagtaatttccacaataactaacggtcaaactaatggtcaattaacggaatgggtatgtaagggatccaaataaaaacttaggggtatataagagattaaacaaattacaggggcgtagaagggattgggtgaaattacatgggcatgtagggaattggccctattgtatatggagtatatagtaaatcaaggataaagatgtaattttccgttgcatatgaataaaaggaaccctccaaggacaagagagggggatctctcccccattccactcattctcatccttactcattcactctcatggtccccacgaggccaagcttaaggtttcctcccattggagggatgactcagccatgtatgttggattttgcaacaacaacaagggttgaagttgtgctgcatcgatttcctatgtttgagaaagaaaaacaattgctggattttgcaggattcacttggagagatagttcatagtactacatggaatcaaagcatcattcgaagaaagtggatatgatttacatcaatcatcatgcattggtgttgtggtcaaggtgagtggagggaccaaaactggtggagtggtgctctcttcttctggttgaaaggactggttaaaaggagggattgtgtgcagcagctgcttgactgattcattcacgccccattttttgagatttgggatgtgattacatgagctttgctagtgtctaacattgttgttttgaacattgtactcctgcgtttcataacataagtcgtttgattttttttttaagtcaaacttctttaaatttaactaaatttagaaaaatatactaatatttttaatataaaacaaacatattataaaaatatatttgatattaaatttaataaaattaatttggtattgcagatattgctagttttttttagaaaatttggtcaaatctactccagcgggagacggcctgctaaactttgaccaaaataaggccgggcccagttaaggtccaatctgccaggcaccctccctccccgcggccggcgccgccgccgccgccgccgcgccatgcccgccggtgctccccgactccggtcgccgaatcgagcccgctctcccgcccggcctgatccctcgcgctcaccgtagaatcatttccgcgccaatgcgcgatcttctgttcctgcctgccgctctaggataaccgtctccacttccatttgggaaaccctagaagtttatgcggatacggccgacggcctcggatgatccagtgatctgctgtccagaggtaaatcgagcaaatccatagccaagctcctatttctccaccaaagtttcagggaaaatcttgcaatttttcgcgacaaatttattgttaggttagctttagtttgctccacattttgcccttggatttcaaagcttaaacacagttgaaccgaactgaccaagatatagatcatctcggctttattaactgctgctgcagtagttatgtgctcactttgtaatccaaccatccaattgttcaattgctgctaattaaagtgccaatttttgcagaaataaaagactgaaggatttcggcctagctgttctgcatgcagaaaaccatatctgtagttttttcatgagagatccccagttattgctagtgtagtagtgttgattatattccatctgtaatataatttaccagaccaaaaaacattaactaccgaagtactagcattatttctgagggagcaaataacaagcctccttcaggaggcttttggaagaaattgataaaaaaaaacaaaccaaggtaaatactgaaaataaaattacaatgtgttccgacaagattgatttattgacacaactttggcgcttccgttcaaaagtcttacataagtgcattatgtaaattttatatctgcaaaaaggtggcttctcttaacacacaaacaccttccaatttaatctctctgcttatgtacttgaatgacaggtatgctgcattcagttattgctgttgattgatctggcttaagcttgggctataagaaatcatcagaccatggccggagatagtgacagctatcattgtgtcacaggtcttggttggtttgcgacctaactgaagtagagctagaaaaaccttgataggacaatctgatcatataacacccctacagcaaagaatgcaccaaaggaaatcataaagacaaatgatgatacaaccttgtcagcattttgttttgtggagacaaatggtgtttgtgctaaaccacaatggcgtgcaagcataggaccacacaactttgggttcccatcaaagctagtacttgggaatgtgctaagctgtcctgcatttggaactggcccttcaaggtcattgttagaaatgttgaatgctgaaaggaagtgaagtttgttcagcccatcaggaattgtaccagtgagattattgctggacaaatcaagcacctgtaggtttgtgagcttgtagattgattctggtatctctccagacaatctgttggaactcaaattgagtaactggagtgccttcaactgaccaatctcattcgggatgatgccagtgaaattattgatgcctagattcagcactttagggaatgcactgtttattcggtattgaagtgcataacctgtacagataggcagctcaaagacctttggtggaacattatctgattttagcattggcatctcaactaaggctgatggaatttcccctgaaaggctgttgtttgaaatgtctatatggaacaagaagtttaggctgctgatccagtcaggtattgctccgtttagttgattgttatataaagatagcatctccagatttgtgagctttgataaccatttaggtatttttccagacaatgaacaatcgttcagggaaaaaatccgaagattctcaaaaccataaatctcgtcatcctctggcatggtctcttgcatgaagttgtacccaataagcaaggtggtcaggttcctgcagctctgaagtatctgaagtgaacctgtgatatttgtaagagagatgtcaacaagtgatacaaatgagaggcacttcagattgcggattttctccgagagctggccatggaagctattgttagacagctgcaatgcacttagatttctgcatgagtagatgctttctggcactgttccggtgaaattgttcgacataagatctaaggactgtaaattgcgtaatgtggagaagttgacattgccaagatctcctgaaaagttgttgcccccgaggttcatgttcttaagatttctgcaatttcctacagttgatggcaactccccggacatgctgttgtatgccaaatggagcttctccagtctcttaagctgacctatcgaatttgggatacttccactaagcctgttttgtccaagatcaatggtcactagatttttaagcttggtgatgcctttgattgatccttctaactggtttctaagaaaacagaggtgcttcaaagaggtcagatcaaatagctcgtctggaagagtcccggtgaggttgttgtagctagcgctcagaagtgtcagcttggagcaattgctgagccccgcagggattcttccactgaattggttatagctgagttcaagcacagcaaaagatggcgcgctggcacagaacgaggttggcatctgcccagtaaatctgttgttgctggcattaagcacaaccagattgttcatcctctcccatgtggttgatggaaaattccctgtaaacaagttgctcgagatgttcaatacctgcagcggccggtcaggggttgaagatggcagctcactcagtcctcctgttaagtagttaaaactgacatcaaggaccacaatgctgctggatgacaccagttccagcggtaagccaccggacaacgagttgcgggacaagttcagcctcagtaaaccggtgaggtcgccgagggatggtgagatgctcccttcaaggcctcttgatgccagagagatcacctcgaccaccgctccgtttccgctgcaggtgatgccttcccaggtgcagcagtctgtgccgttttgccatgacacaccaaggccgccatcgttcgatagcccggagaggaactggaggagagattccctctcctgctcggtgcatgaaccggcatgacagacgaagcaaagcaggagtagcagcagagcttggccgaagggaggcatgcagaatctgctattatctcggttgctgcttgaagagagctgtcttggcattggcttcattattgctatttttcttgaaaactatcactggtttgtgggtttgattttgcaggataggcaggttagtgtgcaagtgcaaaacagcaaaagaataaagttcttgagcaaatatattgccgaatctttcagtcaaaaaaatatatattgccgaatctttccgtcaaaaaatatatgttgccgaatcagacacgaaggacagtaactcaagtagatgaggataaagatgaagattaagtgatttacgtaaaacaaggtggtattaatgtataattaattgagtttgaaaaatttatctgatattttagagtaacttacatatagaaagtttttgtacgaaatgtaccgtttagcagtttgaaaagcgtaccacggatatccaaattttcattcaacttttgttggagaaaagaacggggcttcttggaacaggatagatgagctattgttgacccaagacccatgcgtttacttgttgctgctacggtagttcggagaaattcttataacaaggaatcgtattcaaatacatgtaactaaggagtagttatcagtactaacttttcaaatacttcagtggaagcgtgtttgagggatgtcccggaaggatttgaacccgtttttgtctggctttggtcttatgcttaggtttatattactagtactaagtcgcactgtttgacaggaatggttgcacttgaaatggcttgagtagttgttgacttgttgttcatacacttggctttggctgcttgagtagttgttgttcatacacttggctttgactgcttgatgagagacaaataggagtgattccttgttcctttgagtacaatagatcatcaaaagtctgctatttttcttttagtgagtccttgttcctttgagtacaacagtacaccaagtctgctatttttcttttgatgatctattctactcgcctactcggatgtactatcagtggtcccgttcttttcttcaacaagagttggatgaagattaagattttcgtggcacgtttttcaaactgctaaacggtgtgtttcgtgcaaaaattttctatatgaaagttgctttaaaatatcatatcaatctatttttcacgtttgtaataattaaaactcaatcaatcatacgttaatattacctcgttttgcgtaaaaaacttaatcttcatctccatcttcattttcagaagaaaagagcaccaaagcagttgtgtttgactatcataccgctagtttggtgcgaaatgttgtgcttgcattgcatcagcttatcagtccggaaccaaaatttaaattttctctactatcataaaatgtagagtcgtcctccatccgtcctcttccacagcgtgcagcgaatccgcacgcgtagtgtatgtaatcgccgtatccaatattttatcatccaattatacttatagtctttctatttatatgggtctggctcgttataatataggagtatgttactagtaaaacttaattttagagttgattttatgttttttatcatagtttattttttagcatcaacttttaagtcgctaagaacatatgtataaaagttttgacctcaaattttttaggtccaataagcgttacactgaaacgatgtgtatgggaatgtgcatgggattcgatgatcttcccttgcacaattgctcctcattcagactttcggagtgggcacaccgatgaaagcatgactggctgcctttcagtgacaaatcactgaatgtttgaagattttcagcatttctccctttcacccgcaatcagcctttcctccaacaattgaactgaaatgcgtctactaggtgacaagcctcgacaagcacaaaaactgatctaacaccacccctactccaaacaagaggcccatctgtcttttgaacttggacaagtttcgatttttcaagaacatgaatcttttaaaaaaaaggtgaatattagggaatggcctaatatcaaataaatagaagcgttgaggctttgaacccataccagctagcccaccaacttgtgcagctagctggaaaacccctaggcatttctcacatggatcttttgatatggtggaaatctcttatgatgatcaatcatccacgccttaaacgtatcctaatgcctgaaagttggatagaccggagtgccacgacagtatggcggcccagtgaagttgtcatcagagatgaagctgacgaatgaactgaggtgcatctagccgagaaacctcgacaagcacaactgatctaacaacacccctactccaaagaaggcaccaaatgcaatcacaaagatgaccttgtaacctccttgtctgctggaaccttgaggtgaatctaccattactggatcatcacaatcttgatctagtatatggccgcatagcctcggatttccatcgaagctggatcttgggaatgtatccaggtgtcctccagttggaacaggcccttgcaagtcattgttggagacgttgagtgcagagaggaagttcaggttgttcaggtcagctggaattgtaccagtgagatggttgttggacaggtctagtatttccaggtttgtaagatcaaggattgtttctggaatctctccatgtaggttgttgtagcccagaatgagtgagagtagtgccttcaactgaccaatctctgttgggatcacacctgttaatttgttgttttccagaatcatcactgcagggaaatcactgacagtgaagtacttaggtgatggaccagtgtaaacaggcagctcaaagatctttatgtccaaatgagatgtaaccatttctgatcttagcattggcatctctgttaactctgctgggatttcccctgaaaggctgttgtttgataaatctagatagaatagggagtttaaggtgctgatccaaaccggtattgatccacttaaatgattgttaaacaagaatagcatctccagattcttgagttttgatatccaaataggtatatttccaaacagtggacagttttccatagcaagaaccttaagattctcaaaaccatcaactgttttgtcgtctgaaatttcctcatccctaaagttgcctccaataagcaaggtggtgagatctctagagctcttgaggatttgaagtgtatttgaaatatttgtaaaagagttttcagcaagtgataggtaggttagtgacttgaggttggttattctgaatgagagctgaccatggaacttgttaaacgatagttgcaatgcattcaggttgctacatgtgtagacactctcaggaattgtgccagcgaagctgttatatgagacatgcaaagattttagactagacagtttggagaagttgaccttgccaagctctccactgaagttgttgctcccaagatttaatgctttgagattcgtgcagctgcctatagctggtgtcagctcccctgccatgctgttgtggtgcaagtgaatctcctccagcctcttgagcttcccaatggaatcagggatgttgccactgaacatattgaatccaagatcaaggacaaccaaattcctgagcttgatcatgcctgcaccatcaagaactccctgtaaaccattgttaggaaaagagaggtgctccagcgaggtcacattgaagagttcatcagggagagtccctctgaggctgttgtggccagcctttagcaatcttaacgaagaacagttaccgatctccggcggcaaattgccactgaaatggttgtaagagagatcgagcatggcaaaggaggacgatctgatgcagaagaaggttggcatcggcccagtgaaactgttgttgctggcgttgagcacaaccagattctccatctcctcccatgagctgaacggaaaccgtcctgaaaacgagttgctggagacgttgatcacctgaatgcggcgaccggaagccgaagacgacggcgaatcttgcaggtctccattgaggaggttgaagctgatgtcaaggatgacgatgctgtctgacgacattatttctgcaggtaatccaccggacagtgagttgtgcgacaggttcagacgctgcaaacctggtagcctgccaagagcaggtgatatgctgccttcgagtttcttggaggccagcaagatgtctgtgattgtgacggccttgctggccgtgctgctgctgcaggtgatgccttcccatgagcagcagtctgtgccttgcggccacgatgcggcaaggccaccatggccgtcttgcgagagcccagccaagaactggaggagacagtttctctcatggtctgtgcagcagctgatggaagatgcagagaaaaggatcagcgcaagaacgaggcagagagtaggcatggtcaatttgttgtagttgctgctgctgctggatatgaagaaacttttggaattgatggaatgaaatgcatatggttgtctactgcaatcatcaagaagaacatgtgttcaagcttaaatgcttaggaaaaatatcaatcgagagaaacgagtaccagtcaagactcaagagtcctcacagacaaggtagcagtcaagagtcaagacttggatgctcctctggtcacatccatatgtggatctttcgcttaattcatcgtttcttttgtcttttccatcatttctctgctactgcaagaagaccagttttagttgcagtgaaatcaaagtgtgaatcagtggggagaaaacgatttcagtcgtctgattctgaaaatcataatggttcagttcagtacacccgtagcttgcagagattggattttaaactctcggatgtcccctcataatttgcatgtcacttaaataattgtgaaaagaatttaaaagtattgaaaatatgtattaacatgcgatatatcacttcacaaacatacaacttaaaattcaacttctacatgttgcaatgaaaaaaaaacaaattttaccacaggcatcaaatgccggtgccgacacaatcccgaagagaacagaagagaagagggtcccactcatcacaacattcaaaactggtcattatactgagaaggattatagttggcacggtattatggccgtgtttaattacaaaatttttcttcaaacttctaatttttccatcacatcaaaacttttctacacacacaaacttccaacttttccgtcacatcgttccaatttcaaccaaaatttcgattttggtgtaaactaaacacaacctatgagttgggagatgggctataacttgtatttaagttcatggatgaatttcagacttggcaataaatggagggagctaaagtgaacttatttcctgggcatttcgattcatatgcagcccatttcgatttcctggggcaatctattatctattgtattatcaaaggaatagaaaaaggagcctccacgttcgctctcatggtttagaaattctcacattaatcagagaaaaagaaaaaacagagtccatatagaaatacaatttagaaatagatgaaattcggaattaaaaataaggaatattagaagtagcgtatagagtccatatagaaatacaattaggaaataactgaaattcggaattaaaaataagaaatattagaagtagaatatagagtccatatagaaatacaattaggaaataatagaaatttggaattaaaaataaggaatattagaagtagagtatagagtccatatagaaatacaattaagaaataatagaaatttgaaattaaaaataaggaatattagaagtagagtatagagtccatatagaaatacaattaagaagataaatagaaattcgaaattaaaaaataaggaatattagaagtagagtacaaaatccatataggaatttaaaactaactaaaatttagaataaacataataaaattaaaagtagagtttagagtccgtataaaaatacaatttacaaataactaaaattcgaaattaagaaaaacatgataagaagagtttaaagtcaatataggaatacaatttagaagtaactgaaattcgaaattaaaaattaaagaatattagaagatgagtttagagtccacgtagaaatacaattagaaataataaaaattcagaaataaaaataaataatatttgtcgacgtttaatgtcgcgattccggtatttgcatagtatggggatcgttggtattaggatatatgcgagactgaggtaaaagagatggagacagggatttttatacaggttcgggcccctgaattgtcaggtaataaccctactcctgttggccaaagtcgttcgttgcttattcaccataatcacaccagtacaatatttggggtagcctatctaactgttgtcgacatggcggtctgaagtattatcacgtagtcgacaacagtgtagtcttcctcctcgagttcatgcccagcgagatcagagacagcgttagatccctacagccggcctccgtaggtaccggatagggtcggtccaggcatatctctgatgttgatatccggcgtcttgtcttggcgtatgttggcttgtgtcttgatctattgttccgtgtcccctcttctcctagggggccttgtatttatacacataggtgttcccttgtccaagtagaactagggagaccaatatggatataatccgagtagtccttgtcattttcatgtaaaactctggttgtcttttcttatccggaacttcatccatatccgaggtcagtgtccgtataatacatggtatgtggtgggtcttgtcgagatttagtcaactactattaggtatgtggtatccataaccctgacaatattggaagaagagcatagagtctatatagaaatacaatttacaaaaaattcaaaattaaaaaaaaagaaatattaaaagacgaatctatagcccatataggaatatatataatttacaaataactaaaattttatattgaaaataattaataactaacacgtatataaaatataataaaatataatattaatattacgcatcattagttttgtaaagttattgtaaaatttaaaattatgatgtcatttcaatgctaaccgcgcaatttgattgcgcgaaacatcatgctagttgagtattgaaagccgaaaggcccaaccagaaaacatttcccacaggcgtctgtctcctcctcctcctcgtcgtctccacggcgacagcgccgccgcttctcggtcgccggcgcacccgccgtctcttcggccggcgggggctctcgaggaaggcttccgcgccgccatcagtaccccgaatcgggtacgcacttcgcaacgcgcggccatctcttctctattactactcttccctgcgtgtgaatctgaacaggacgagttactcttattattattattatttcttatcggtttacctcaatcttttgtacaatgctgatgataataaaactagtagcacatgattctcaaattgtacatcctttctcaaagtacaaatgattttgacgaattcaagtactgaccatctttcagaatgctcattctgcacacctgagttgtgtcaactgaatgatggtctttaactaagtaggtaaatttattgacccaaatcatcttatgctcatatcataattgaagaaaccctagcctggatagtaacatctgatctaacagcacaccaagtgcaaagaacaagcccactgtgatgccaaagatgttgacactgaagttatctgtgtaaaatgcaggcgtgggaatagcttttgctgaattacactggcgactgatcataggaccacatagctttggattaccatcaaagcttgaattatcaaatgtatcgaactggcctccagttggaataggtccttccaggtcattgttggaaacattgaatgcagaaaggaagtgtagcttgctcagttgtaaagggattgtacctgttagattgttgttagacaagtctagcatctccaggtcggtgagcttgcaaattgcttgtgggatttccccagagaaactattgtagctcaaatcaagcatatcgagtgccttcagctgaccaatctctggagggatcacacctgtaaagccatttctgcctatatttagcgttgctggtcccatcagtaattgatgccttgaaccgctgcaaacaattattttagagaccctttcatttagaatggataccatcttctttgatttaagcactggcaactgtattaatgttgttagaatttcccctgtaaaattattatttgttatgtctagatggaagaggaagttgaggtttttgatccatacaggtactgatccagttaattggttgtcgtataaatgcaacttctccaaatttgtgagcttcgatagccagacaggcatttttccatacaacgaggacccacttattgagaaatgctgtagattttcaaaaccatcaattgtttcatcctctggcaatacctcattcttgaagttccctccaataagtagcatttttaagttcctgaaggtcttgaagatgtgaagtgcagttctgatattagtaaaagcattatcagcaactgataagaagacgagagacctcagtctgttcattgtctgtgagaactccccatgaaaattgttccttgcaattctcaggacaatcaaattggtgcatgcataaatgctttctggaactgtaccactgaagttgttcacaagaagatcaattgtcgttagattagataggctggaaaagtcgattttgccaaggtctccactgaggttattgaacttgaggtcaaggattttgagatttgtgcagttgcctagagttgatggcagctccccatacaacttgttctcacccaaacggagttccttcaatctcttgagctgacctatggatttgggtattttaccactaaacatattctgttcgagatcaaggattgacagtttgctgagttttataatattggcatcatcaagtactccattaagaaaattgtctgggaaagaaaggtactccaacgatgaagcgttgaatagttcatctgggagagcaccatggaagttgttgtgaccacccttgagcactctaagcgtggagcaattgcttatgtctaggggtatgctgccaccaaattgattgaaagagaggtcgagcacagcaaaggatggtgcattgatgcacaaagaactcagtatctgtcctacaaagctgttgttgctggcattaagagccaccagattgttcatcaccttccatgtggtggatggaaattgccctgcaaacaagttgcttgaaatgttcagtacctgcagaggccggatagttgtatgagctgagagctctttcaaagctccactcaagtgattgaagctgacatcaaggatgacgatgctgctcgacgacaccaactcctccaatggaagttcaccggacagcgaattgtgtgacaggttcaggtggagaaggccagtgaggttggcaaggtatggggagatttgcccttcaaggcccttagaagccagcgaaatttcggtgatcgttgcatctgtgccgcaggtgatcccttcccatgtgcagcaatccgtgtcattctgccatgacggcgaggccaccgtcctccgagaggccagcgaggaactggaggaggaagctcttctcctgatctgtgcaggagccggtggaagaggctaaacacagtagtagcacaacaacaaacccaagtaaatcggtgggtaatttgctgctgcttctgctgcatggaaactgggaaggtctcatgatggatcttttttttatcagattgagtatagtctggaactctggataaatcaatatgcagtagtgggcattataaggccagaaacttttttgggttgggagggaagtactcgtaccagagagggaggcagaaccgccgtcgagggagccctcgccggagccccgagacggggactgccgatcgctggtaaacgcacctatttgcgtgggccgaagcccagcctagtgggccaatcagtaaacctggttcaacttgcaaaggatggtaaaaataggtggtgtaaagtgaaaaaagtgacccacccctagcccaatgtgcaacttagatcaatataagtggtctaaagtgaaatttactctttatattatataagacactttgacttttttttcttaaactatttaaaatttgactaaatttatagaaacacaacaacatttttaacaccaaacaaatatggtataaaaatataccaaaaactaattggtgttataagagtagttatatttatatacctctataattttgatttagaaaaaaaataaaatgcttataatatgaagagggtgtagtgcttaggttccagaatccagctaggaactggagcaggtaccgaggcatcagcacaagaaatatggatagtttgtggctgctggactgctggtgctggatgaataattatttttcccctggaaaaggacattggtttggtcacatccatgtgattttttttttcaaaattgtactttactgcgtttaattttttttgggcgaaaactaacacggttgatatggattgtttttttttctctcttcaaaacagtactttattgcgcttgatttttttttggcaaaaactaacacggttaatatgatatggagtgcttgcggtggaatggaatgaccatggcgccacgctgggtgcagttgccatatttgttcgtagcggcttaaaagttaacgctaaaaaaactacattaaaaatatattaaaatgctttgcaaaaaaagattaaaattaagtttaaaattcaaatttaagattttgctttaacttattaggccaatgaggtgcgggctcaccggccgccggcgaagacaagagagtgctccacgagttcacggtaggacgatttacgtgcggcccatttttgttgggccgtaactggattgtaactagaatgcggcccataatagttggtccaggacgggatttcgattacgtgaggcccaaatatgggattagttgagtagggcaagggcccaagacttggcccaattgccacaggcaccgtctcgtcgtctccgtggcgacagcgccgccgctgctctgtcgccggcggccagcgcaaccgccgcctcttcggctcgccggcggcgcgcggggactcgaggaaggcctctgcgtcgccgtcactactacccatagctcgagtatgcaacgcgtggccatctccatctgctctctattactactattttcttagcgtgaatctgaaaattgaagcgatatagttgcagacgatggggattctcaaactatacatactagttctgatagagacaaatttgcacatgattttcacgaatttgagtagtgaccatcattcagaatgctcaatctgcacacctgagttgtggcagctagattcttgtcttcaactctgttcatagagttggaaaattaatatgccttgaagagatcttagcctttttagtaccatctgatctaatagcacaccataagcaaagaacaggccaaatgtgatgccaaagataaccttgtcaccgaattgatctgtggatgaagtagggctaggaagtgctcttgctgaattacagtggtgactgagcataccaccacatagctttggattaccagtgaagcttgagttgtcaaatgtatcaaactggcctccagttggaatagccccttccaggtcgttgttgtaaacattgaatgcagaaaggaagtttagcttgttcagttctaaagggattgtgcctgttagattgttgttagacaagtctagcatgaccagcttggtgaggttgcagattgcttgtggggtctccccagagaagctattgaagctcaagttgagcatatcgagtgccttcagctgactaatctctggcgggatcgcacctgtaaaaccatttttggctatgtttattgttgtgtggatatattggtattgtcggtttttgatgaatggaatgccgtaaaatctcatgtttgggacacttacatccagattggttctcttgtctgacttcagcattggaatctgcgttaatattgttggaaattcacctgtaaggttgttattggatatgtctagatagaagaggaagttgaggctgttgatccaggcaggcactgatccgcttaattgattattggataactgcagcaccttcaattttgtgagctttgatagccaaagagaaatttttccatgtaaagaagaaccacttatttctaggtactgaagattttcaaaaccatccattgtttcatctgctagcaatgtctcatggttgaagttccctccaagaagtagagtttttaagttgctaaagctcttgaggatgtaaagtgccttcgtgatattcgtaaaatcattccaaccaactgacaggcaggaaagagacctcagtctgtccattctgtgtgagaactcaccatggaatttgttccacgaaagtctcagtgcaatcaaatttgtgcaatcataaatgctttctggaattgtaccattgaagttgttcacgagaagatcaattatcattagattagataggctggaaaagttgatcttgccaaggtctccactgaggtagttgatcttgaggtcgaggattttgagatttgtgcagttgcctaaagttgatggcagctccccatacaagtagttctcacccaaatggagctccttcaatctcttgagctgacctatggacttgggtatgtttccactgaatatattctgttggagatcaaggatagacaatttgctgagctttataatgttggcatcatcaagtactccatttagatcattgtttgggaaagaaaggtgctccaatgatgaagcattgaatagttcatctgggagtggacccttgaagttgttgcggccacccttgagcactctaagcatggagcagttgcctatgtctgagggtatgctgccaccaaattgattggaagagaggtcaagtaccccgaaggatggtgagttgatgcacaaagaacttggtatctgtcctataaagctgttgttgctggcattaagagccaccagattgttcatcaccttacatgtggttgttggaaatttccctgtaaataagttgcttgagatgttcagtacctgaagaggccagatagttgattgaatgaagagctcttgcaaagctccactgaagtgattgaagctaacatcaagaacgacgatgctgctcgatgacaccaacccctccaatggaagttcaccagacagcgaattgtgtgaaagattgagctgcagcaggccggtgaggctgccaagagacggtgagatctgcccttcaagggccttagaagcgagcaaaatatcagcgatcctcatgtctgcattacaggtgatgccttcccatgtgcagcaatttgtgccgttccgccatgatgcggagaggccaccgtctcctgagaggccagcaaggaactggaggaggacactcttctcctggtctatgcaggagtcggtggaagaagctaaacacagcaccgtcagcagagcaaacccaagtaaatctgtgggtaatttgctgctgcttctgctgcatggaaactgggaaggtctcatgatggatcttttttttatcagattgagtatagtctggaactctggataaatcaatatgcagtagtgggcattataaggccagaaaaatctgaaaagagctgccgtgaagtctttgctgactgcagttactggctgagtggctggtcatcacaaagacaattcagaggtgaataagagccaccacctgcaatgcctttttgctatcaatggtccacggtcaattgttcatagattgagcagacagtaacaacatgaatcgcctgcagttctgcaaaacggtggcagagatgattactcaaatgcagcaggaaagtagggaaaatttcaatggtctagacgtgcatatcctggaacatatgaacaggatctttcaactgccatcaaggtcaaactgcacatttcgaccgtgtgagggagcctttctttcctagctgcttctggaggataagaagttgatagaagtatgaaaagtcctggtagcctcctgttgtcatctttaccggtcttcagccgtcaagactcgggaacaaatatcacctaagctcttctctcactttgcttttttccccttgtgttgattgaaggcgtaaaactgaaggtgctagcagcaaattttggtacatcgcatcttgtcagcaagcatgcagcttgaccgtttctttgcttttgctgttctacaacaaaagatacctcttgaaaggtgtacttaagtattgttataggtatttaggtggaaagagtaaaatgataaattaggccggagagagaaaatagtacaacagtcttgaaaatagcattagcatcagtaccgcatcggtacaactcccagtagcgattttctctactggcataaattacatgatcttcctttatttatattgtgttcctagatgagcataaaacttagtttggttctccgtcccctccatccccccccccctccccccccaaaaaaaaaagaccaatactatctacgaacttggacatatatgtatctaggttcgtagttagaaattcgttttttttgacagagtagtacctcattcaataatcttgtccactacattatttgtgttccaagagcatcatcagtaaaggtatcaccaatatttgtgtggttctttggagatttattctttttgaagatcatagtcagttaaaatatcattgatcctaagaaggagacccatcctgaatcagactcttatcggcactaatagatagcctttttatcacgtaaatgagtaaccaactacgtcactaatcagtacaaaacttaccgcctcccacttgtgacccaaggcggcgcttctccctgtaatatgcatccatcttatagaacacatcaaactctaggtaggagatgaagaagaagaagaacaggaaagaacgagtcacgaggaagaagaacgataaatgagagattggtcggattgatatcttttttctcctttttttgagaggaaaacttcatgtttccattaaaccatggacgcggcagaatcgccggcgaccaaaccctcaacacccggaggtgcaccgtccccaaagagatcggtgtttgggggactgttacatccgatcgatgctatagcatcagctaacttattacaatcacgcggacaaaagctaaacttgcaagtaagaaaagacgaggcgataatgttcttcgcttcaaacagaagagtccccaacggcgcaaactgaagatcttctcccttcagggcctgaataagcatcatagaatcagactccaaatgaatgtaagccatgcccaaactagtagcagctttgagccccttaactcccgccagcacttcagcatgaaaggcatcctggagccgtgacgaaaaacctgctcccgcctgtattacttgtgcttcagtatccctgatcacaaaaccccaacctcccttttgttcctgtggcttgaaggctccatccacattaattttcaggacatttccggtaggtctagcccattttctatttgatctagctgcttgaccactcccccgttgaggcgccaaatccttaaattcatctgcttgtttctgtatggagaaagccaggatattagctccccttcttccttctccctccctatgtatgtttctctcattccaccatgagtacagcagaacaatggcatgtatcctttgtttttcttccagctccagtatagcctgtaaaactgccaaagctgactgcaccgctgctaacttgcatcgtacttcttcaaggttgaggtctctccatatgtgtttgacctctttgcatttaaaaaagaaatggctcccgctaaagatcaagcatttggtatcaatatccattccccttctcttgagagtcatctggagggcaattgtgtcatgccccaatcgccacatgaagtgtttcatcttgttcggacagttaagcttccagagccttttccatacttgatcactttgtgcaccccccgacgaagatgcaggtgcacttctgctgtttcttctctcaatttctttctgcactttgtaggcagatttcatagaaaagaggcccctcttatcataatgccaccccactacatcatccctgtccacttgaaccggaattgacagaatggccttgacatcttcttcacagaaagtttgcctcaccagcatctcatcccaatcgcccgtataaggatctatcaattcatttactcttgttagcatgttcgtgcccttattagatacagtttttctcgtccagtctctagggatccaaggatcatcccaaatgccgatggaattgccattgcccactcgccaaatcatgccagcctaaagagtctgcagcccttttagtatgcttgaatgcttctccatgtatatgacatgcccgatcttggtttagcttgcagaattgatccagatggataatacttggccttcagaatctgagcacacagagaatcaggctcctgaagcagccgccagcattgctttgctagaatagccatattaaagacatatatatctctttttttctcctatataacaaagaagtattgatctaattatagatgtccataagttacttagttaactacttaacgccatcggttacgataatttattccataccttgcccatgtcattatcaacggttcatgttgccctaccttctaatacttctatgtaccttctacacacctcacaaacactataaaagatctctaagtaaaaatatcaatcgagagaaaggagtatcaatcaagactcaaagagtccttagagacaagggttgtgtttagtttcattcaaacttctaaaaattccgtcacatcaaatgtttagacatatgtatggagcattaaacctggacgaaaaaaaaaaccaattgcacagtttacatgtaaattgcaagacgaatcttttgagcctaattacgccatgatttgacaacgtggtgctatagtaaacatttgctaatgacggattaattaggcttaatagattagtctcgcaatttacaggcggaatctataatttgttttgttattagtctacgtttaatacttcaaatgtgtgtctgtatacttcaaaaaaaaattagctgtggaactaaacacgaccaaggtatcagtcaagactgcgatgctcctttggtcacatccatatggagcttaattggaaaattattctaaactctcaaggggctatcccttattgtttgtatgtcactcaaatggttataaattttttttaaaaaaaaatgaactagatggattaatatgtgctagatcaattaaaatttaacttctacatgatgcaatgaaaaaaaaatttgactgtgaatattaactagctgtagtttaatttgttttttgtttgaaatttatagaagttgaattttaacttgcatgtttgtagagtgatatattacacgttaacacatcttcttaattttttttatttttttcataactatttaagtgacatacaaataataaagagatatccccttagagtttaatccactctcgagcttaattcatcgtttccttcgtctttcccatcaattctctgccactgcaaggttctagatgcagtgaaatcaagtgtgaaaagtggggagaaaacgatatcagtcgtctgattctgaaaatcataatggaggtctgaatggtttttgtcacctgtagcttgcacggcacgaacgaacaattttgcctagcaaaagaatgtttccccctatggcaaatcagttggcaggtgaggtgagatgcagaaattcatcaattgtaagttgcattaataagtcatgcataaacgttgtcagttaagtatcactgagttttctactctaagtctgaactggatacagtcaaagtttacaaggaaacgtagcaacaggccattgactgaaacaattcaactacaactgatactaatcgagcaggccagaaaagagaagttgaaaaggttgctttctgactttgttcagatcagcacaccagaattctgcacctagtagtattagaaatgaacctaagctagtcaggtatagcagaatcctaagcttcagctagtcaggtatagcaaccagatgaaggccgagtttagttccaaaatttttcttcaaacttttaacttttccatcacatcaaaactttcctacacacaaacttccaactttttatcacatcgttccaatttcaattaaactttcaattttagcgtgaactaaacacacccgaagcaaaactccattgctaatctgacgaaattgttcagaaactccatttctcacacaagaacagcatgaccaagatgcaggaacttcaacttctcctagtccttgctgctcttgtgctgctctccttcctctctcctgccacctcctgcacggagcaggagaagagctcactcctccagttcctccgcgagctctcgccggattccagcagcaagttctcccggtcatggcagagcggcacaagctgctgcacgtgggaaggcatcgcctgcggcagcaatggcacggtgacggagctctcgctgccgtccatggcgctcgagggccccatctctgtatcaattgccaacctcaccggcttgcgccgcctcgacctgtcgtacaattctctctccggcgagctcccaccggagttgatctcctccgccagcgtcgccttcctcgacgtcagcttcaaccgcctcaacggcgagctgcaggaatcttcaccatcactgcctcaccatcctcttcaggttctgaacatctcccacaatttcttcgccggggagtttccgtccacgatatgggagaagaagagtgatcttgtcgcgatcaacgcgagccacaacactttcagtggcgcgctgccgtcttctttctgcatcagctcgccatccttcgctgttcttgatctctcatacaacctcttcagtggcagcattccagctgagataggtaagtgctcttcactcagagtgctcaaggctagcaacaacgagatcaatggcagcttgtcagatgagctctttgatgcttccatgttggagcacctctcttttctgaagaatggtttggaaggagagcttgatggtaaatgtagtttgtgaattttttctctggaagcttcaccccttcagtattgctatcgttatttacatatacatgagtagatgggcctctagctgatgggccagcacacaaacacacacacacacactattctatttacagcccaacactccccctcaagatgggtgatagatatctatcatacccatcttgtcacacgaacgattacactctttaacacctaaaccctttgttaaacaatcagcaacttgtccactagacgttacaaattctaattccaaaactccctcatccagtttttccttgataaagaaacgatccaactccacatgctttgttcgatcatgctgaactgggttgttagcaatgttgattgctgacttgttgtcacaccacaatttcatgggagtatccaccgacaactttaactcagaaagaagattccttagccataacaactcactcaaactcactgacattgcccgatattctgcctcagcagttgagcgagacaccaccggttgcttcttgctcctccaagatactaaattgccaccaacaaacacacaatagcctgaagttgatcttctatcatcaggacaacttgcccaatctgcatcacaatagccttcaacctccaagtgtccatttttcttaaaccataggcctttacctgggcttcccttcaaatatctcaagatcctatagaccgcatccatatgaccactccttggatcatgcatatatcgactcaccatactgacagcataagttatgtcaggtcgtgtatgacacaaatatatcagtcttcccaccaatctttggtatctttccttattcactggatttccagactctgcacataatttatgattttgatcaattggtgtagaggctgggcgacatccaagcatacctgtgtcactgagcaaatccaatgcatatttccgttgtgacagaactatccctctaggagatcttgcaatttcaatacccagaaaatatttcaactggcctaggtccttaacttcaaattctttgcttagattctgtttcaacctagtgatctccaagcaatcattcccagtgataatcatatcatcaacatagacagcaaggatggttatatgatctccactatgatgataaaaaactgtatgatctccattacattgcttatagtccatagcacacattgcacgcctaaaccgatcaaaccatgctcttggtgattgtttaagaccatacaaagatttcttcaatctcagcacctttccttcagtttgtgaagtagcaaatcccggtgggatatccatatacacctcttcttgaagatctccatgtaaaaatgcattcttgacatctagctgatgcaatggccaatcaaaattagctgcacaagatatgagagttcttaccgtgctcatctttgctactggtgcaaaagtttcatcataatcaattccatatgtttgactatatcccttagccaccagccttgctttgtatctttccacctttccattaggattttgctttactgtataaacccacttacagttgacaactttctttccttcaggaaatggtacaagatcccatgttttgttcttttcaagagcctctagttcatctaacatagcttgatgccaccttggatcttgctttgcttctctccaatcctttgggatttccattgaatctagtgatgctacaaaggctttatatgtggatgacaaggagtcataggaaacaaagttggatatattattttcttcatcaccctcatcttgatcttcaaaaccataccttagtggaggtttacctgcattgcttctcacactctttctgacagcaattggtaagtcagattcttctctaacttcctcttcttctccccctgactccaaagacccttgctcatgacttacatctttctctacctgattatcctcttcaacttgttggattactggacaccttgttctccttgtgtatacttgaagattttcctcttcatgtggcttcctccattcttgctcctgtgcaacaggaccacccataggatatggaattgaaccaaccacaaacttttccttctttgattgttcatctccctttggacccaatatttcaccttccatctgttgaccatcatgaccactagttgaattatcaagatcaacgaataaagaacttaaatctgtcttctcaccgtagaatgggacagattctctaaaagtaacatccatactaacaaaagttcgtcgttctgatggactccaacacttataccccttctggccagatggatagcctataaagatgcatttgacagcccgaggatcaagttttccaacggaaggtctatgatctctaacaaaacaagtgcaaccaaacacttttggtggaacaacaaattcattctttccaaatatcatctcacatggtgtctgcattccaagtatccttgatggcgtgcggttgataagataagttgctgtcattactgcctcactccacaagaatttaggtacattcatagcatacatcaatgagcgagctgtctccaaaagatgacggttttttctctcagccaccccattttgtggaggagtatcaggataagaagtttgatgcaatattccttctgatgaaagaaagctactaaattcattgtttatatactccccgccattatcagttttaataaactgaactcgagcattaaaatgatttttaatgtatgcatagaaattctggaagcatttaaacacctcatccttatgcctcataagatataaccatgtcatgcgagagtagcaatcaataaaggtaacaaaatacttcattccactcatagagaccataggtgaagtccaaacatctgagtgaattagcataaatggtaacatacttcggagtcctctactcacatatgatgttcttgtatgttttccatactcacatgcatcacatactaacttatgtttatccactctacttagttctgctggaaacatcttgctcatagtttcaaaagatatatgccccaatcgacaatgcaaaagtaataccttagcctcttctttacttgtagaagccatcaatgcaagacatacatcttcacttgtctcctttcgatccaaataccaaagtccatcacgcctgatgccagtcccaagtttcttccctgtttgcctctcctgaattaaacaattctcacgatcaagggatacccgacaatccatatgatcaacaagagaacttattgaaatcaaattcactggaaaagaagggatatataacactgatgataaagtgattgaaggagtacattgtactgttccctctcccttaactgggcatgatgttccatcagcagtttcaattgtttcttttcgtgtaaatgggtatggtttatatgatgcaaattctccacacatacccgtgacatgtctggatgcacccgagtcaagtatccaatttgaatgagaactattgattgacataaatgcttggtttgagttacctgagatagaatgaacaaggttggcaacatcaacatttgtaggtccagaacaaccctcttcaagagtgaccacattagctctgtgatcacctctatactcatagcctctacctctgttagctctacctgcataacctcttccacctcttgctccacctctatcaccacttcttcctcttccataactaggcttgcgaggagcacgacaatcacgcatgagatgccccatttcaccacaattaaaacactctctagtctctttaccttgtagcattgcataggtgggacttgatgaaggtggtgtagccttaggcaatactttcctcttaagctcatcttgagccatagctgctatagcctcatccaaggtaggaagagtagtctgatggaacatagcatcttttctcccttcaaactctggatttaggcctttcaagaattcaataacccttctgcgctcaatccatttcctcatttttgctatacaatcggggtgctctaacccaagaggatcataatgatccaaatcagaccatagatgcttcaattctgcaacatattctgcaatagaacgctccccctgtctcaaagcacttatcttctcccgtgcctccaccattagcatcacatttccttctcctgagtagagattagtgagagttttccacatctcacttgcacttgagatggtctcaacagttgtagcaatagcagggataagtgaagtcaacaaccatgctactactaaagagttggtagtgctccaagtcctccattctgcactagcactctcaggctccttcacttctccggtgacatatccttctaatcccttagtcttcaaaatcaacaatgctctccttgaccaacttaaataatttttgacaccctccaacttaatatcattttgcatcaagtcaattttttgcattgtttcagtatgaggaatcactgcattacttgtagttggggcctcactaaatttctttgcaagcatgtccaccaatttacccatcacttgttcaagtccctgattttcccccattttaatcaagcagcactcaactaactgctgtaacaaagcaaactctccttgtctacactccaccagcagcactaacaacaagccaacaattcctctaccctgtattttcttcccagtaaatcagtagtagcagcaagaacaatctcgattacctcaatcttgaagaagaacaacagtaacaacagtcactagtgcttcttccctcaaccacaagccacagtacagagtccaccaccagccaacaagcagaagcacggctgggaaccaactcaacaagcagaagcacggctggggaacccacttgtagctgctgcccctccagacctccctgctcagctcacgcacctgctgtgtgttgccgtcaccgccgctcgctgcagcagccgcgagcgtcctgacctgctgcgcctccagtccactcctacttgtccctgctcaccgtcctacaccaccaccaagaactccaacctcagcgcttgctccctcagctagggttcgtcgccgccggccgccaggagcacggctctgataccatgtagtttgtgaattttttctctggaagcttcaccccttcagtattgctatcgttatttacatatacatgagtagatgggcctctagctgatgggccagcacacaaacacacacacacactattctatttacagcccaacagtaaacagatagccaagctcaagaatatagtagttcttgatcttggatcgaacaatttcatcggcgatattccgggtagcataggtcagcttaagagattggaggagctccatttggactacaacaggatgtccggggaattgccatcagctctagggaactgtacaaatctcaagatcatcaacctcaagtacaacagcttcagaggagagcttctgaaggtgaacttctccggacttcccaatctgaaagttttggatcttgagtcaaacaagttcagtggagaaattccggaaagcgtctaccatgcagcaatctgacctcgctgaaactatcttcaaacaaattctatggacagttgtcaccaagaattggcaacctgaaatccctcttgttcctatcactttccaacaatgcttttgtgaatattgcaaatgtgattcatgcactcaagaactccaggaaaatcaacactttgatcataggaaccaacttcaagggtgagaccatgccagaggatataccaatcactgatggttttcagagtcttcaggttctttccataccatcttgctcattgtctggaaaaattcctctttggctatcaaaattggccaagctggaagttctggatctgtccaacaatcaactcactggaccaataccagactggatccatgacctgaacttcctctacttcatagatatatcaaacaacaaacttacaggggatctcccaacggcaataatgttgatgccaatgcttcaacctgacaaggttgcaacccaattggatcccagggcatttgaacagcctgtctatgcagggccatcacttacatatggcaagaacaatgctctccctgcaatgctgaatcttgcaaacaacgagcttaccggtgcgatcccttcagaggttggtcagctgaaatcactcacattgctcaacttgagcttcaacagcttgtcaggacagattccacagcaacttttcgacctgacaaacctgcaggtggtagacttgtccaacaaccatctctcaggttcaattccaccggggctgaataacctgcacttccttacaacatttgatgcttctaacaacgacttagaggggtggattccagctggtgtccagtcttcatatccgtatgatttttctggcaacccaaagctgtgtgatcctacactcactcgcacctgtgattcagcagaggcacctccagtctccacgctcaccggagaagaaaccactccaaagatcgtctttgcaatcgctttcggtgcgttcttctgtttaggtgtggtgtatgatcaggcagtattatcgaggttttttggctagttctattgcagttttcatgtgtttttttttataaaaaaattggtcagtttggtgtttggacagagctattcaggtccaagcggacacgtccactgaacaagttgtgtgtactgtagttgcgagtgaaatatagcttttgttcatgtttcccagtggaggaatattttagttattttccactcttctcgaaatgtcacttttcccactgggcattgtggcgcaggtaacaataattaccaagttgtagtgctactgccggtaggaaagaaataaaatacaatatatgtacagtgatttcaggcacatgcactaaaataatagagtagcagttatagctgttacatttgtagccattgtaatcttgttacagcaacgctgcagcttcatcctctacaaatagaaacacaactcagttttgcatttcatcaaacaagatggatccccctaatagagattttatgcacgtgcttagccagggctctccaagccaaacttgaaatggtagccaaaactccacttctcctcaattttctcccaaacatagtttgctcgatcctcaacacccacttttcagaacttctatacttttggggctctaaccaactatcaactatatgacaattctactccaagcttccactgtttaccgagagaaactttctttcaatttgccactttccccgatgcggcttaccagccatcgacgtaaccatcgttgagacaaaagtagcagacgtggatccacgtggatctttcgcttatactaggttcatttttagatccttttatttatttaaaataagtttatttttaaaataatcttcgtatcggagtttgtgaaagtagaagtagataaagtgaataataattatattggggtttgataaagtagttatattctagtttttatggctttgtagtggtacgtgtggccatgtgggatgagtgaaaaataaatttattttggaactgatgtagtactacttcattgtttcctttgtctctcccatcaattctctgctagtgcaagaagaccaattctagctgcagtgaaatcaagcagggccggtcctgacatttgggaggccctaggcgaacttgacactatgggcccttataggaagttaaggctatttttttttacttctaatatatatactctataaagcatataccatagagtgacacaaataaacatttctaatatgataaataatcaatcaagtagtttgcaagttgcaatagagcaatttattctcgatgaataatatcgatagtataattgacaactaaaaaaacacaattgaaacaaatgagtatgaataccttaataggagacaacaaatatcctatgtcccttataaaaaagagtttcttctcgcatttcttgaagcgaaatcaataatgacagtttgaagatcaatgtcgtgcaagatattcttctcaatctgcagatagccaagccattcaaccttccatgtgacatagttgaccttaaatagtttttcaataattgatattcccgttttctttttgtttcttttctgagcacccgacaaatgtttttaggtaacattataacacctgaaatagggaaattgcaaagcaaattatatctatacaacaataactatgaattgaaattaattgataaaggcatagttcaatgacctaccttagtgctggggaggagaggcaaacaattgatgacgaattgacgatcagtcgatcacgtcgatcacaggaggaatcactcaggcggacccagacaggcagccatgcaccacagcggttggctgggccggccgccagcgatggcgaggcgagcaatcaggcaacggcgcacaggcagtcaggcactccatctcccggtctccgtctctgaagtctgatcactcggcttggtttttggctttcacggtcgcggacgcggactgtctagggcatcggcggcgattcgggatttcagggcgacgaagcgacgcggctcggcctcgatctccgcctctccggtctcgcgagtcgcagccgcgggcagatcgaagcgacgcacaaccacactcgcgcacgcgcgctgatcgctggactctgttgggcctaccgcctgtggtgctgggctgggataggggggcaggggggtaagtgatgggcccccctccggcctgggctctaggcggccgcacaaccggcctacccctagggccggccctgaaatcaagtgtcgaacacaaacagtggggagagaatgatattggtcgtctgattcagacactttgtgtaggtttatacttactggcttagacttttaagtcagtttattggtttatatgatttgtaagtcggtggatttaatatcctaagtttagtgatggagttatacatatatctcacataaaccaaaaaagcttctctaacctagtttttggcttaatagtgttagtgtggcttatagctttaaaaaagtcaaactgaaaaagatgcttgtttgtttaggcttagacttttatgcttataagttggcttataagcctaaacaaagagggcctgaatggttcagtcacccgcagcttgcgtttgcacgacacgaacgaacaattttgcctaacaaagattgttttggccgatccatgcgtgtatggcaggcaaagggtctctttgggaaagcttaagattctgagaagcaactagatgatagccagcttagaatctggaaaagctaggtttctcggcttttggcttctagttcattttctggattctagaactacagcttctcagaatctggacaaaaattaaactgtttggtggagtttctgattctaggagaagttgtagcagcgaagctcccccatacaggcccaaaatcagtactcgcagagggacggttattgggccggaacgggagtgcaactcacgtgcggcccatactagttgaacctcaacggggttctcgtctaggtgcggcccaagaaaggattctgacgtacggcccatgagtttttggaccaaaattttgtgtggcccaagaaagttaatgggcctggcagaccaagaaagtgtgtgggcctgaacccttcggaacccaaacattccttggccacatcgccgtctcgtctagtctccacggcgacggcgccgccgcttctcggtcgccggcgcacccgccgcctcttttcggctcgccggcggcgcgtagggactcgaggaaatgcttctgcgtcgccatcactacccgaatcaagtacgcaaagtgcggccatcatttctctcttatttactactctctttttctgtcgtgaatctgaacgttaagagagattttttttcttcttcttttactgtacctgaatatttgtgaatgctgatgattgatactacttgcgcacgattctcaaagtgtacatactagttctagcagtggcaaatttacacggaattttgatggatttgagtagtgaccatcatccggaatgttcattctgctgaacacctgcaaagagttgtcacaactggatgctgttcttgaactctgtagtctgttcatgtagtttggaagatgtggtttttcatggacggttgaccaaaattagctcatgctcatctcagaattgaagaaatcttagcttggaaagtaccatctgatctaacagcacaccaagtgcaaagaacaggcctactgtgataccaaagataaccttgtcactgaattcacctgtggatagagtagaggcaggcgcaggaactgcttttgctgaactacaacggtgactgagcataggaccacatagctttggattaccaatgaagcaatctgtgaatgtgctaagctggccttcagttgggataggcccttctaggtcattgtaagaaatgttgaatctggttaggaagtttagatttttcagtgctgctgggattgtaccagatagtttgttgcttgataaatccagtgttagcagatttgtgaggttgcagatcgactgggggatatctccatataatttgttagcgctcaaattgagttcaaggagccctttcaactgaccaatctctggagggatcaaaccagtgaatttattgctgcctagatccagcattatggggaaagcattggccttgcggtattgaagtagtgatgtaagactatatatgggtagttgaaatgctctagggtgcaattggacttggactgcagacttctctgacctaagcattggcatctgtactaaggctgttggaatttctcccgtcagattgttgtttgatatgtctagatagaagaggaagtttaggctgctgatccagtcaggtattggtccagttaattgatttctatttaatattagcatctccagactcgagagttttgataaccatcgaggtatttttccatatataaggagcaagcaatttgggaaagaacctgaagattgtcaaatccatcaatgttatcatcgtccagtattctctcattcatgaagtttcggccaataagaagggtggtgaggctgctggagctccttaatatctgtagtgcatttgttatgtttgtaagattgttgtaactgagtgacaggaaggaaagggatttcagattacctagtccctttgataactggccttgaaacttattggaagatagccgcagggcagttaggttactacatgagtatattgtttctggaatcttaccactgaagttgttccacaaaagatctaaagcttttagattgggtaggttggagaaattgacattgacgagctccccactgaaattgttgctcctgaggttgatggttatcagacttgtgcagttgcttaaggttgatggtatgcccccatacattttgttgttgttcaaaaggagttcttccaatctgttgagctggcctatagactctggaatgttaccactgaagttgttctctccgaggtcaagagtagccagcttccctagtttgataacattttccccttcaagtgttccatgtaaattgtcgtttggaaaagagaggcactctattgaagtactcagcattgaagagttcgtctggaatagtcccacaaaggttgttgtggccaaccttgaggactctgagcctggagcaatttccaagtccagggggaatgctcccactgaattggttgtaactgagttcaagcacagctaaggatggcaagttggtgcagaaattagttggtatatgcccactaaatctattgttgctagcactgagcgtgatgagatgcgccattccgtctaacgacggcaactccgtggaaaacttgttgctcgagatgttgagcacctgcagaggcaactttagaccagtggttagtggtggcgacagtggtagaattctgccgaggctgttgaagctgacgtcaaggatgatgatgctgcctgatgacattacttctgatggtaatccgccggatagtgagttgtgcgacaggttcagacgcagcaaacctggcagtctgccaagagcaggtgatatgctgccttccagcctcttggaggccaacaagacgtctgtgaccatggcgtccttgctgaccatgctgctgcaggtgatgccttcccatgagcagcagtctgtgcccagccgccatgacgcggcgaggccaccgtcctgcgagagccctgctaggaactggaggaggcagttgttctcacgctctgtgcagcagctggtggaagatgcagaggaaagcatcagcacaagaacgaggcagagaatagacatgggtaatttgtttttattgctgctgctactggttgtggtggtggtgggtgatgaaaatttgaaactaatggagtgaccatatataatgttgctattctgaatttgtgattttcctcaattcagtcggtacatattaattgagagagagaggaataaagcagcaacttggtacagattgcttgattgtcttctagagctagggaccgcagggacaaaaatatcagtccttggatgcttttttcgtgaaacacggcttaatgttaacccaaatcaagtagcagtacaaccgtttctgtctttcagatcaattccctgtgaatgcatggcaacctgctctggttgcagtgaaattaaagtgtgaaaaactgaggagaaaacgatatctgttgtcagattctgaaatttataatggaggtctgaatgattcagttacctgtaagttgcacggccggaagaatgaatgctacggggtggcatccaatccatgcatgttcggaagatcaatcggcaagtaaggtgaggctgctgtctcagaattgaagaaatcttagcttggatagtactatctgatctaacagcacaccaagtgcaaagaacaggccaaatgcgacgccaaagataaccttgtcactgaattgatctgtggaaagagtggaggcaggagcatgaactgcttttgctgaattacagtggtgactgagcataccaccacatagctttggattaccaatgaagcttgagttgtcaaatgtatcaaactggcctccagttggaataggtccttccaggtcattgttagaaacattgaaggcagaaaggaagtgcagcttgttcagttccaaagggattgcacccattagattgttgctagacaagtctagcatctccaggttggtgaggttgcaaattgcttgtgggatctctccagagaagctattgaagctcaaatcaagcatatcgagtgccttcagccgaccaatctctggagggatcacacttgtaaagccatttctagctacatttacttctgctcggaggatgcgatattcatatttccaatctttaagtgcaggtaagtccttttttgaggacatatatgtcggtaatattaagacccttgcatcaatattggccactgtcttctctgatttaagcattggcatctgtattaatgtcatcaatatttcccctgtaaagctattatttgatatatctagacagatgagaaagttgagtttgttgatccatacaggtaccgttcctgttaatcgattgtcatataaaaacaacttctccaaatttttgagcttcgatagccagacaggcatttttccagataacgaggacccatatatttcaagatgttgtaggctttcaaaaccatcaattgtttcatcctctggcaagatctcatgcatgaagttctgttcaatagatagcaccgttaagtttctaaagctcttgaagatgtgaagcgcatttctgatattagcaaaagcattaccaccaactgataggaaggaaagagacctcagtctgtccattctctgtgagaactcaccatggaatttgttccatgaaagtctcagtgcaatcaaatttgtgcagtcataaatgctttctggaattgtaccattgaagttgttcacgagaagatcaattatcattagattagataggctggaaaagttgatcttgccaaggtctccactgaggtagttgatcttgaggtcgaggattttgagatttgtgcagttgcctaaagttaatggcagctctccatacatattgttgtggcccaaatggagttcctccaatctcttgagctgacctatcgagttgggtattttgccaataaacatattcctttcgagatctaggattgacaattttctgagttttatgatattggcatcatcaagtactccatttagaacattgtctgggaaagaaaggtactccaacgatgaagcattgaatagttcatctgggagagcaccatggaagttgttgtggccacccttgagaactctaagcatcgagcaattgcctatgtcctggggtacgctaccgccaaatcgattgaaagagaggtcaagctcagtgatggatggtgcactgatgcagaaagaacttggtgcctgtcccgtaaagctgttgttactggcattcagagccaccagattgttcatcaccttccatgtgtttgttggaaattgtgctgtaaataagttgctcgagatgttgagtacctgcagaggccggatagttgtttcacttatttgagctgagaactcctgcagagctccacttaagtgattgaagctgatgtcaaggatgacgaggctggttgacgacaccaactcctccaatggaagttcaccggagagcaaattgtgggacaggttgaggcgcatcaggccggtgaggttgccaaggtatggtgagatgtgcccttcaaggcccttagaaaccagcgaaatttcggtgatcgttgcatctgtgccgcaggtgatcccttcccatgtgcagcaatccgtgtcattctgccatgacacggcgaggccaccgtcctccgagaggccggcaaggaactggaggaagaagctcttctcatgatctttgcaggagctggtggaagaggctaaactcagtaatagcacaacagcaaacccaagtaaatccatgggaaatttgctgctgcttctgctgcatggaaactgggaaggtctcatggtggatttttttttcttctcagaatgggtacagtttggatagatcactatgcagtagtattatattgagtaaagatactttagaggtgaataatagccacagcctgcaatgcccatttgctaccgatggttagtttcagaagaactttgctaccgatggtccttgttcattgattgcgcagaaagtaataccgatgactatgttatcccgtgcctgtccaattgttgcattggttcagacaactgtgacgaccgctgtttcaagcttgacaattgacaaaactatgaaaaatcctggtcgcctcctgctgtcatctttgcctgtcttcagccgccaacactgcagcaatatcagctaagttcttctctttgtttgtttccattttttcccctcgctttgattgatggtgtaaaattgaaggtgctagcaacaaattttggtacctcacaccccatcagcaactaagttgcttgaccatttctttgttgctgctgctctttgctcgaccttcctggccaaagaaaagctattttcttttgcaaccattcttagttaaatccttgtcacattgacatttttacatcatcctgatgacttctcttggctcttgcagcttcagatgatagacgtgcttgcttgccaccaaaaaggagaaatgcaagcatatgtttcatgaaacagcctgagctcaattgaccaaaggctgaagcaacatgctaggggaaaaaaacagttgttatgttttttatccattcagttaaaacttataagtagtaagcacaagagaggcagcaaggccagcaaaattcagatgactactcagatgcagcatgaaagtggagtacatatcctgacctggaacatatggacaggatatcaggatcttaaactgccttcatgatccagtccattttgactgtgcgcaagagccctttcttggctagctgcttctcccaattgatttttgagtgtcccaacatgcactgttttacaacgatctacgttgagcaatgaatgttttacaaataagttcacatcggaatatactttgttcctattattattgcttattactctctttgttttatattagagtaaatttcatcttgaaccacctatattgaccaatgtggcataatgggctagggctaagtttctcttttcacttaacaccacctaattttacaatctttttcaagttggaccaagtttacggcatgggctgcgtttcggcctaatccacgcgagcagctggtgtttgctcatggtggcagtggtgcgcgataccaggagcgtgcgcgacgcgttggtgtggtcatcggcgagggcgagcatgtcgtcgtccagtggacacggactctgtggtgataacgctcggccctgtcgcgctcaaaacaatactacggcacatctgattacgttgacaggatctgagaccataccagaactatcccattcagatcatgcatgtgaatcaagatccgatcttctctttaattttcttgtgaaaattcgacatgtttccggttaccaaccgaggaacacggattaattactctagttttttcgaagagcagcagaggaatattgattacccccacaaaacccaaatctcataggaattactgaatgcattgctttgtttcactctcccaagccccagggtcaaaactttcctccatggattgctccatgatcgaatcgcagatgcatatacctgtctacctcataaacccaacaagcatcctagcaacgaggcagccgacgaccccagtgattccatcctcgggaagccatcgatcgaggtggcatgggcgtccaccaggcagaggccctttggcctgacgctggcgacacggttggatgacgagacttgctccaccttggcgccggtggacggtggacacggtggcgtttgtgtttcgattgttgagttcacgccgctgcacagcagccgtgtgtgaacagagacttttttgggttgggaaggaagtactcgtaccagagagggaggcagaaccgccgtcgagggagccctcgccggagccccgagacggggactgccgaccgctggtaaacgcacctatttgcgtgggccgaagcccagcctagtgggccaatcagtaaacctggttcaacttgcaaaggatggtaaaaataggtggtgtaaagtgaaaaaagtgacccacccctatcccaatgtgcaacttaggtcaatataagtggtctaaagtgaaatttactctttatattatataagacactttgacttttttttcttaaactatttaaaatttgactaaatttatagaaacacaacaacatttttaacaccaaacaaatatggtataaaaatataccaaaaactaattggtgttataagagtagttatatttatatacctctataattttgatttagaaaaaaaataaaatgcttataatatgaagagggtgtagtgcttaggttccagaatccagctaggaactggagcaggtaccgaggcatcagcacaagaaatatggatagtttgtggctgctggactgctggtgctggatgaataattatttttcccctggaaaaggacattggtttggtcacatccatgtgattttttttttcaaaattgtactttactgcgtttaattttttttgggcgaaaactaacacggttgatatggattgtttttttttctctcttcaaaacagtactttattgcgcttgatttttttttggcaaaaactaacacggttaatatgatatggagtgcttgcggtggaatggaatgaccatggcgccacgctgggtgcagttgccatatttgttcgtagcggcttaaaagttaacgctaaaaaaactacattaaaaatatattaaaatgctttgcaaaaaaagattaaaattaagtttaaaattcaaatttaagattttgctttaacttattaggccaatgaggtgcgggctcaccggccgccggcgaagacaagagagtgctccacgagttcacggtaggacgatttacgtgcggcccatttttgttgggccgtaactggattgtaactagaatgcggcccataatagttggtccaggacgggatttcgattacgtgaggcccaaatatgggattagttgagtagggcaagggcccaagacttggcccaattgccacaggcaccgtctcgtcgtctccgtggcgacagcgccgccgctgctctgtcgccggcggccagcgcaaccgccgcctcttcggctcgccggcggcgcgcggggactcgaggaaggcctctgcgtcgccgtcactactacccatagctcgagtatgcaacgcgtggccatctccatctgctctctattactactattttcttagcgtgaatctgaaaattgaagcgatatagttgcagacgatggggattctcaaactatacatactagttctgatagagacaaatttgcacatgattttcacgaatttgagtagtgaccatcattcagaatgctcaatctgcacacctgagttgtggcagctagattcttgtcttcaactctgttcatagagttggaaaattaatatgccttgaagagatcttagcctttttagtaccatctgatctaatagcacaccataagcaaagaacaggccaaatgtgatgccaaagataaccttgtcaccgaattgatctgtggatgaagtagggctaggaagtgctcttgctgaattacagtggtgactgagcataccaccacatagctttggattaccagtgaagcttgagttgtcaaatgtatcaaactggcctccagttggaatagccccttccaggtcgttgttgtaaacattgaatgcagaaaggaagtttagcttgttcagttctaaagggattgtgcctgttagattgttgttagacaagtctagcatgaccagcttggtgaggttgcagattgcttgtggggtctccccagagaagctattgaagctcaagttgagcatatcgagtgccttcagctgactaatctctggcgggatcgcacctgtaaaaccatttttggctatgtttattgttgtgtggatatattggtattgtcggtttttgatgaatggaatgccgtaaaatctcatgtttgggacacttacatccagattggttctcttgtctgacttcagcattggaatctgcgttaatattgttggaaattcacctgtaaggttgttattggatatgtctagatagaagaggaagttgaggctgttgatccaggcaggcactgatccgcttaattgattattggataactgcagcaccttcaattttgtgagctttgatagccaaagagaaatttttccatgtaaagaagaaccacttatttctaggtactgaagattttcaaaaccatccattgtttcatctgctagcaatgtctcatggttgaagttccctccaagaagtagagtttttaagttgctaaagctcttgaggatgtaaagtgccttcgtgatattcgtaaaatcattccaaccaactgacaggcaggaaagagacctcagtctgtccattctgtgtgagaactcaccatggaatttgttccacgaaagtctcagtgcaatcaaatttgtgcaatcataaatgctttctggaattgtaccattgaagttgttcacgagaagatcaattatcattagattagataggctggaaaagttgatcttgccaaggtctccactgaggtagttgatcttgaggtcgaggattttgagatttgtgcagttgcctaaagttgatggcagctccccatacaagtagttctcacccaaatggagctccttcaatctcttgagctgacctatggacttgggtatgtttccactgaatatattctgttggagatcaaggatagacaatttgctgagctttataatgttggcatcatcaagtactccatttagatcattgtttgggaaagaaaggtgctccaatgatgaagcattgaatagttcatctgggagtggacccttgaagttgttgcggccacccttgagcactctaagcatggagcagttgcctatgtctgagggtatgctgccaccaaattgattggaagagaggtcaagtaccccgaaggatggtgagttgatgcacaaagaacttggtatctgtcctataaagctgttgttgctggcattaagagccaccagattgttcatcaccttacatgtggttgttggaaatttccctgtaaataagttgcttgagatgttcagtacctgaagaggccagatagttgattgaatgaagagctcttgcaaagctccactgaagtgattgaagctaacatcaagaacgacgatgctgctcgatgacaccaacccctccaatggaagttcaccagacagcgaattgtgtgaaagattgagctgcagcaggccggtgaggctgccaagagacggtgagatctgcccttcaagggccttagaagcgagcaaaatatcagcgatcctcatgtctgcattacaggtgatgccttcccatgtgcagcaatttgtgccgttccgccatgatgcggagaggccaccgtctcctgagaggccagcaaggaactggaggaggacactcttctcctggtctatgcaggagtcggtggaagaagctaaacacagcaccgtcagcagagcaaacccaagtaaatctgtgggtaatttgctgctgattctgctgcatggaaagtggaaaggcctcatggtgggttttctttttcagattgagtatgagttggatatttactgttcattactcttatattgagtaggaatgaaagcaggaacaaatttcatctttgttgattgcagttgctagctgatcgagtggctagtcaatggtcatcacaaagaataagtggtcaaggtcatcaggaattcaggatcaaaagatgaattgagagttgaatgagagtgacaacctgcagtgcttgcttgctaccgatagtacagtcattgattgggcaggcagtaacatcatgaattgtgtcgatcacaactttattcagcagtgaaggaaatatcctggaacatatggtgtagtaagtggtaagttagtagaccaagtcttccctttccggttgatcatcagctgttgcatttcgaaagtttgattccctacctatagctccacatttgccggctgtttaccgttccttttttttccataattttgagtttttgacaacaatcaaaccactagcttcacacgaaatgttgtaaaatctgtagcaaatatggtaggctctacgtatatacatgcatgtttcatacttgaataataacgtaggagatacatttcatcaaataaaagaagtatgcttaatatttcattggggctcatcagagaagcttagttctgcagtgctcagccctggttgatgctggagctggaggccaggacacaggtccagcgcccgtgatcctgccttgcagagcccttggaaaattgcaggtgaaactagcatgcatgcaggtatgaggtaaccaggcttgctaagatttgctcaaatctgttgcagatatagtaggcactataatcccataaatatcaagtctctcgaaataaaatgatgatttttttaaggattttgtctttgttttcttgtacaatgcaaatcgtggcaagtactgtttatttcttcttgtgtactcatatatcgatgttgttattcagcgatcaaagtgaatgatgacaataaagttacacggaattctgcaagaatgaatttttgatacatttagactgcttcgattcacatcatcttacatagctgtgtacttatacattaccagaattcctggatcactcttcacccatgtattccttccagtttattatcaaaaaaacgagttccctccaatgtccttttctttatttttgtattttccgcctttcataggaaaacctgaaccagaacaagaggtatatttcgtgcacaactagactaagcttgtaaccggacatgctgcttggatcttaacagcagctcaaactgaccaaagttatcacaaaaagtacatcagatctgcaataggactagccaaaaaaaaccttgataatactatttgatcatatagcacacctacacagaagaatgcgacaaaagcaatcgcaaagatggtcttttgagtgctttgttctctggagtctgaaaactggaggtgtttttgccgatgcacaggtgcgaatgagcgtatgaccacacagctttgggttcccatcaaaaccccaatactcatatccaattggaactgacccctctaagtcgttgttagaaacatcaaatattgaaagtgagtgcacattgttcagtcctggtgggattgaacctgtgagatggaggttagacaattctaacacttgcagatttgtcaggttgaaaagtttcggtggaatatgccctgaagagctgttgaagctcaagaagagcactgtgagtgatttcagctggccgacctctgaaggaattgcaccagtaagcttattgtttccaagatttagcattgcagggagagcattggtcataccatatgtaagtgatggctcttcataatcagcataaacaggaagttcaaatacccttggatccaaatgattgtagcattggcatctccattattgctactgggagatcccttctaagattgttgtttgatatatctatgaagtagaggaagttcaggccatggatccagtctgatattggtccagtgagttaattgtaggatagatccaaaacttccattttgagcagttttgaaagccaacgaggtattttttccagacaacgagcaagaaggtaccgaaagaacctgaagactctgaaaaccatcaactattggtatgccatctggcatggccttgcccttgaagttgattcccataatcaaagtgttgactttttgcagttcttgagtgcatgaattgcatttgagatattcccaaaaacattgttgtcaagtgataggaacaagaggtacttcaggttctgccagtttcatttggaaggaagctggaattttttttcccaatgtaatgagtagagggtatagtctgcccagtttcagggtttctccccctccagtcggaggctgtgcctcggaccatgctcgacatgcttttgtcgatgtaactatacttttgtactttgttttttttttactaattcttaatgaaattggttggccactctttggctgacccggcaaaaacgagggacttcaggttgtctattcttggtgacaactggccatagaatttgtttgaagatagctgtaatgtggttagattgctgcatctgtagatgctatctagaatttctccagtgaacttgttcgacataagatccaaaagtttcagattgggcagtctggagaagttaaccttcgaaagctctcctgtgaagttgttgtgcttgaggttgatgatcttgagacttgtaaagttgcttagagatgatggaaacactctggacatcctgttgttatccaactggagctcctccaatctattaagctgacctatggaacccggaatatcaccgatgaagttgttatgcttgatgccgatgattttgagactagtacagttgcctagagctgatggcaactccccagacatgctgagtttagtccaaatggagctcctccaatctcttaatctgacctatggaacccggaatatctccgatgaagttatgcttgatgctgatggttttgagactagtacagttacctagagctgatggcaacttcccagacatgttaggtgtagcccaaatggtgcttctccaatctcttaagctgacctatggaacccggaatatcaccgatgcagttgttatgcttgatgctgatagttttgagactagtacagttgcctagagctgatggcaactccccagatatgttgggtgtagtccaaatggagctcctccaatctcttaagctgacgtatggaacctggaatatcgccgatgaagttgttatgcttgatgctgatggttttgagactagtgcatcttggccgttttgagacttgttcataacgcgcaatttcaccaggagattatggaggatgatgcaggggtggatcggcatcgactttccgttgcctacagggaacgaatcaggcattgctgattggtggatgaaggcgagactcgcttttcggacgggctacaggagtattttcgacagtgcctttgtgctaacttgttggctgctgtggaaagagtgaaatgcgcgtgtctttgagcaaagattttgaagcatagagcaacttgtgcaagctatcaaagaagagatcatcgtctggaagacggcaggagtgttcagatcgtgcaacaacgagatcacgtaatatgtaattcatatttgtcgaagttttagcttaccgggtcggggtcttacccctatcctttacgacagcatactgtcgttgtaagttttaacatgtaacaaccccccccccccctcttctcttaatgaaactagtatggtggcctgcgcaaattgcgcggctagcatcattatattttctctcatataatagcatatatgttttctcattatattattaaaatatattacaatgataacataattttaaattttgcaataactttacgaaactactaatgtgtaatattcatattgtattttatatacgtgttagttattaattatttttaatatcaaaatttagttatttgtaaattatatatattcctatatggactctagactcgtcttttaatatttctttttttaattctgaatgtttattatttctaattgtatttctatgtggattctaaactcatctttcaatattctttaatttttaatttcaaattttagttacttctaaattgaattcctatattgactttaaactcttcttcccatgtttttcttaatttcgaattttagttgtttgtaaattgtatttttatacggactctaaactctacatttgattttattatgtttatttcggattttagttagttttaaattcctatatgcactctatactctacttataatattttttaattccaaatttctttttttttattaattgtatttctatgtggactctatactatacttttaatattccttatttttaattccgaatttctattattgtatttctatatgaactctatactctacttctaatattccttatttttaattccgattttcagttctttcctaattgtatttctatatggactctagtctcctcttgtaatattttttattttttaattccgaatttcaattatttctaaattgtatttctatatagattctagtctcctcttctaatattccttattttttaattccgaattttagctatttctaaattgtatttctatatggactctactttttctttttctccgattaatgggagaacttttaggtcatgagagcgaacgtggaggctcctttttattccgaattttagttagttttaaattcctatacgaactctatactctacttctaatattccttatttttaatttttaattccaaatttcagttatttcctaattgtatttctatatggactctagtcacctcttctaatattccttattttttaattctgaatttctatttttttcttaattgtatttctatatgactctatactctacttctaatatttcttatttttaattctgaatttctattattttctaattgtatttctatatggactctatgctctacttctaatattccttatttttaattccgaattttagttctttcctaattgtatttctatatggactctagtctcctcttctaatattccttattttttaattccgaatttcaactatttctaaattgtatttctatatggactctagtctccttttctaatattccttattttttaattctgaatttcagctatttctaaattgtatttctatatggacactgctttttctttttctccgattaatgtgagaatttataggccttgagagcgaacgtggaggctcctttttctattcctttaataatataatagattggtcgaccgaacctttcggccgacccggcaaaaaagttttgagactagtacagttgcctagagctaagggcaactccccagacatgctggtgtagtccaaatggagctcttctaatctcttaagctgacctatggaacctggaatgtcgccgatgaagttgttccatccaaaatcaaggattaccgtattaaggagtttgatacaagtttttccctctatgcacgaatctcaacattttttctttttttttttttgccagggcagccgaaggaagggccgtccaattttattcagatttgggagatggttacacgaatctcaacattgatccgatggtccacgaagcgaaagtttcttggagaaaaatctgtcgacaatagcaaatctgttctcaaatagaaggctggtgaaccatagctagcaaaggagaggtgctccaacgaatctattttctatgagaaaaatctattctatgctcatactttttcttactattttctatgagaaaaatctattatatgttaatgacttgggcactctatctactaatgaaatttgcaacacaattaagaagttatatcataaaaaatgcaatgagatcttgtatacttgtggggttttcattttagaatgcgcaaaaggattgcgcatcttttgtattaagacttgggaagtttcaacaacaaccagccaacaactcagaaaatgagaagaaacaaaggctaaatggctaaaagaagaggcctaaatctcacgacatctaaattgcgaccgagaacatgacaggcctactctggaagcagacatgcttccctccacaggcctacttctgcttccctccacgggcctaattatggggtctgtctagctgagctgtttttttttaagaatgcatttaaggattgcgcatcttttgtattaagatttggggagtttcaacaacaaccaaccaacagctttgaaaaaaggaaaaaagaaaacaaagaaacaatactggatagctaggagtaggggcctaattctcgcggcatccgacttgcgaccaagaacattaataaaaccattattaatagcagtgacgtcttgcacatactgtatgagtcattcccaactcaagacattaataaaaccattattagttgtttgttgtcttgatcatcgctggaagcatgtcctagttgagctcaactcatataagatgggttaaatatgtgagggtaaaaaggaaaatgcaattacatggaaaatttatatatggattgcagtgaccacttgttgacaataccattagatggcacagaagttcaatatcctgcaaattgattgaggtggcatcagttttttggacaatttttgagctggcttcatgcattaagtaggtattctcagaaccaaaacaaatatactacagtaaaaaagaagtcacaatcaggcagattgtagtaaagaatgtcagctagacatgcccaaagtcaaccacatacgtgctgttgtgtagtcacattctcaaagtcaaccaaaaccaaaactaatcaaatatacctgttgtttttgtgtaggctgtcctaggtaagcaatgacgaggacacagcagcataggaagctggacaaggcatttcagagatcacatccatttcaaggtactctatccatcccaaaaaaaaattcaatcctaattacgagtctggacatatgcgtgtctgcatgtcaaggtacgtagctagaattttttttagacaaagtggtacatatgataaaggttggagaagagcagtaaacagggacaccacatcgtcgtcaatggcgtctgcggcgatgagcaggtaactactaactagcttgctgcagaggtcaatcaatcaatcaatcggcaagattcacagaattccattgctttcatgctgtgcaagaagatcatggcgatgaattagatgattaattaacttatggcttgcagcaacaagaaggagctggaagccctcccaatcgtcgacgccggcgaggttcgtgagctcatgagctccggccaccattacctcgatgtcaggtagtacactctatctacaatctctatggtattagaatgttctagaagcttccatgctcccctttctgtttagctaccattcttcacctgctgccttgctgctgatttgattaatgatcattcctaactgtcacttgatttgcctttttcttgtgttcctggctgcgattaattgccggtgaattggttcatggaatcttcaggcttgggaaggattttgacaaggcgcatgctgacggtgctcgcaacatttcctactacctctcagtgactcccagtggtcagttcagttcatcattcttgccttgctccactgaagaattcaaaattttgtgatttccatttctttcatatgagttttccactgtttattttctaaaccttttgaagctttttgttgctgatggttctactacttgtgttcatctcaagggaaggagaagaacccacactttgtagatgaagtggcttcactcttcggcaaggatgagcacctgattgtggtaagctcaccatcacatatagcactgtattactgacaattaaccatagtcatgtttttttcagctacttcaccggattattgtcacggattatttgctccatgcctttaaaaatatgttttctcaaaaaaaaattctactgtgttgcttagattgcttgttcaaagctatttgttaagtttattatgagaatatttagtttatatctataatcatttaggtaatccactgtaataatacggtcaataatctgttttaaactagacctgtcaaggtcgaaaagctgaagctattgatgtagctaatatactccctccgtttcaaaatgtttgacaccgttgactttttagtacgtgtttgaccattcgtcttattcaaaaaatttaagtaattatttattcttttcatttcatttgattcattgttaaatatactttcatgtacacatatagttttgcatatttcacaattttttttaataagacgaacggtcaaacatgtgctaaaaagtcaatggtatcaaacattttgaaacggagggagtatataataatataaaaccgcaaatttgacattggaatatctgcaatttctaccatggtttgggcacaggcttgcaacacaggtgtgcgatccaggctcgcgactaaggaccttttggacgcggtaattaaagcctgtccattctcgatttaagcacaatatgcatatggttttgagtaattgggggtcattagtttaatccgtcttttggatgtgaagggattcaagaatgtgaggaacctgaaaggtggttaccaatcatttctccgaagtgaaagccagcaacctgcagctcatcaacagtaattatcagctgcagttcccctgctcggtgctcgctatccgggagatggaaaatcgttttcttcttatgcataatttcaatggtcgtgaagacgaataaatcaggatcagttgaatccaagctttgcagtgtgtacggtttagcaagaaaatctcataatgtcatcaatcaataaaccttcagaaaatctttaagaagtgttgccatcagtgaggctaatgccatgtcaactgcttctgttgtactcatctgccgctatattatattcagtaacttgaccttaattttattccattttacaatacctttttctgattaagctgaccatttcttttctcttgtgtactacactcttgttccttgtccatatcacatacaatttaagagtacttagcattacaagtaattaaattacagaataaccttttctgatacaaactcagtgacgggaattaacgataaccaaacaaaatgcgtactactctatttggtataagaagatcgcagaaatgtctggcagagctgtgtgaccacatcatttttggggcttcgtagcctgacatatggaacaaaattagtgcatgtcagattagctccttactttccgacatggatatgttgtcaattggttcctctggcccagctgaaaacaaactatgcttcctctcaaatgaattagattcagttgaggccaaacagaggtctttacacaaacgatagacttgtgctgattgcaaagctgtttcatagcacctccttttctagtttcaacacagccataaatgcctcttgaggaacatcaacccttcctattgctttcattctcttctttccctcagcctgttgggaaatgtcaaatggtcatatcatcttatctctaattggcgatagtgaataaagctactagctttggctaagcaccccaaaagaaaaaaaaaacttatttgaatctgagatggttgtggagaaggcttacctgtttcttcagcaatttctttttcctcgatatatcaccccctgaaagtaaaagaaaataatgtccaacataaacttatggaaattcacaatgtgaaaatgcagcgatccttttttttttcctatagatacatatttgaaacaactagtcatgaacagaataagacaacagagattattccaatggatttatgatgatctcaaagtgcaagtcttagtgttgtttaccatagcattttgacaagacatccttcctgatggctgatagtgcttcacttgcaatgacctttgcacctatacatgcctgtcaaagtcctagttagaatatcattcctaattaagagataattaagcagttttgtctcctcatgaatagatggctacttctgttttccaacaagttataaaccttttttttggtgcagaacaatgatttggttgaaataagaatacaagatcaaggcagcagtggtaccagtggcttctttaattttgttttagttaaaaatgcaacatcagttcaacaacaaaaatggatccactttctttcttaatataaacatcttatagggtagacttaatcacaaattacaaccagcaatatttccctgcctcagtttgcagtgcaattgtatagacaagaaatcaggtagaagcaaagcgataaatctcacttgaataggtactctaaacatttgccgaggtataagctcttttagcttttgagttagcgccctcccgacagagtatgcctatgacaaaaaaatagaaaatcagattggcctgagcaattattgcatgataaccagttaaatataagccattgcttctcaaagtcaagttggcgggagaaaatattcaaagatacagttaatcacacaagaagaatcacggaatgaattgtaagcatgaatatattgactgcagatttcttaacagagcatatggatacatcgaagtataaaagaaataaatcaagggacttaatcctaaactaaagcaatacatccttaacaacaaatacaatgtatatgaaaatccaatcatatttcatgttcctactatctcttgtggtttcatataagtttgatggcattggtggtgtctctgaatatcacaggttgtctcacgtagtcacggtatagagctacatttttcaaggatgtgatagagaatagacccaaggcaagaccgtaagagtaatagcttccaaatttcaagcaagtgtttaacagaaagtgagtttgcatacacccaacttttcttatacacaaatatgtatgatcatgaatataatagcactggctagtaagcaacttgagtttagtaccttatctctatgaacaattgttgacagtgcctccacaggatcaccattgatctgtatatccagctttactaggttactttccctgtacctgcaaattaggcaaatataatatgtcagttgattttacagaagaaactattaagcactggcaatcgggtaaaacaaaaggcaggtaactagctatgggttaagtggtaaagtaataaattttagtagtcaccaagtgttactcatatgcatcccaggtgccaggacattctaagatcaaaagaacttagtatcttattaatatcacccatcttagacacaagttaatgttgtttggaaagcaaccacctctattcatgcttcttcaaatatttaaaatgatcgttaaaatgagatatgcctttttacataaccaactgttacatcatgacattatgaccattacagtgtcctggacttgatgactagagagatattaaattaagagaacaagggtgcaagtacccgataagtgaatattccatgctagcatatcctttacttcgagatttcagttgatcgaaaaaatcaccaaccatctgcaaaaatgggtacaaataagtatctacagagaatccaccagtactatgcagcaagtcaagtatatgctctggaagatatgtacttcttgatgtttaagaatatacgctagcatgaaccaaagagttgagattacacaaaattgagaacaaaagaacagcattagagacatcaataaatgaaatatgcttaccctaaaggcctgtttgcattatgatgaaggtattagtgactggtgcatattttatactccctctgtcccagtttatagcgcgtgcaaatatttttgctaagaccaaggtgcgagcgtggagagaagtttgttactgttgcaaccctaattaagtgcattaattttatcgcttcgtttggacgtggaagaaacttgagggcccaggccatctgcatgcgtctgcacgctctatgcgcaggctatgctgaaactacatcatgcatcattaacagggctaatctcaggagaaatggaaccggtttaaagttgcgccttatgttgtgggacaccagtgaaaatattgtgcgccctctaaactgggacggagggagtaatctgtacaacgtagaaacccttcaaacgtctaaacaatcatgtcctctctatctgaaactcctgtttgcataatgctttatgtatgttggaggagttaaggtatgttttccccttttatttgctagatgaaaatagttacaatgaggtgcaacatgcatggtaatgattttatatagaaaaaggaattacctctgctagcggtagctcataaacaactgatgccctattttctgtgatgaagttcatttccttgaattcacctcttctctcttgacccagttccattattgggccaatatactcttttggtgtaagcatgtcaatctaaataaaaaaaaaatgcagagatcaaagaagagaatcagatacatgcagaattcaacactcccaatcttaaagatgactgtaatggacggtgaaagcctgtatacagaagaaacaaccttgacatatggctcttcgatggatctccgtttaccaggttctggaagcaaggatggattcgaacattcaacctatattacagcaataagtaagcatgtcagtacattaacattccaatgccaaataaacaacactgacatgtccactagtcaaactgaacaagtaattgcttgattaactctattgtaaggaagtctagtctagcaaagtcgagcaagttggtgcaaacatatgcaccctgcaatgatttaattactacatatatgcaagtaacaattgttaatggcttccttaactcactttctctaatgaagtgctcaacaactatttccttgaagtgggagaaatggtaagatgaaattatgacacattgttcagtgttaatcttgttgacatgctcaacacaactgtagatgattcttcaaaaaaagaatacattgataaaggacatatagcatagttaaaccttgcaggccctagcaattactaatcctaacagcaggagatagagaagttcttcagggtcataaagaacttacagtttcgccatcggctaggttgacatggtaaactacactgggtgcagtaattattaagttcaagttatactctctctcgagcctttcctgaacaaagagaacattatgttgtcgaaatttcaagtcaccatagctgtaatatgagatggactagtgagagtgaagtagattataagaacctgcacaatctccatatgaagaagaccgagaaatccacatctgaagccaaaacccatggcacttgaagattctggttcaaactgcattgaaaaccttgttactgcctttagaaaagcaaagatgagaaatgcaatgcacaatgctaattagtcaccaatcaacattggcaatttggcatctgccataccccctagctttgtgaaatgacttgacagatttgcttgcatttccctctacatatgatccaaacattcactcgcctaactctaaatgagaagaaatgcatcaacttttctttctaactgaactaatgtattcattctttccacaatcaacttttactgcatatttcaattttataaaaatgagataaaaaatatagagtttcttcatcaaaatcatattgcctttattttgcctgcattcaatatggagtatcatgttcctctatgaagtttctacagatgcattgtgatgcagggacaaaggtaagtaagaagatgcttcaacttcatatactggaaatgcaaacaaaccaaaacagcttgaaatatgcatttgtgctaatctggtgatcttgtctcaagatatatagggcaggaatcccacctttaaagcagcatcatttagttgaagcttttccaatgcttcacgtaactcctcaaacctaacagacaaccatatttaatatgtgatccatgtgcagaaaaaataatggaaaaaatttcaagggaaagtatagtactgatccgcatctataggaaacaagccacaaaaaaccattggggtagcttgggaatatcctggtaaagcacattctgctctttttgaagaatgagtaattgtatcaccaaccctggcatctgcaactgatcttatggacgcagaaagataaccgacctgaaaaggaatggtcaatgatcaaaccacaaagaattcttttttgcaaatattgcattactaacaacattagcttaatggtgtatcaatagcatattcaggaagccagatcaaaatctggcatatacatagtaggtaccgatgtttatatactgaggaaaatggggatctacttcacaaaaaaaataaagtggaatgaagatatagtcaaacataagatttatggttgatgtaagatatggtaacacaaaagttacctcgccagcgtaaagttcactaacttgcatctgattgggagataatactccaatttcatctgcaacatattcctgtttatttaaaaaaaaactcagcatggtgtctctacatagataaggatgatgaagatgatgggtgtagcatttgatttttagaagagttaattataaaagagtaaatgatattatacagagaaaaacctaatagaagtgtagggggaaaaaataatgctcctgtgcagttgtgtataacaacagaaatcagatggaatgttgcaaaagttgtacgtttacagtttaatagagctattttttcccaaaaactattttatcatagcaaaacactctagtttgcttcagagatttcaggctttatttagttacctttccgctagccataaaacatattttgtcccctttctttatactgccatcaacaactcgaaaatatacaattacacctctgtatggatcataataactgaaacccatagacaaacaagaataaggattcaggtatatgcacaaaaaaaaaattgaagaccattgtagtatcattgtctgcattttgtaattttagcacctgaaacatccattgaggactgaggagattctaaatagtctaagttcttaaaagatacctgtcaaatataagagccctgagaggacttattgcagtattctgtggtgggggtatcttagtcacaatggcatctagtatctcagttatgcctatgccctcctataaacaaacaaaaacaaagatgttaatatatgtttataaagtgggggatagaactttctgtgcataacgcatgtgtaagtaactctgaaggctgaacagagataaagtagcaaaaaaacaacctttgctgagcaacgaattgcattactgcagtccattccaattatctgaggataatagaaaaaagacaagcatgattttagcaataagaaccaatgtggcataacattgaatggaaaattcaggaactgttgtcagcacaatccagtataagaaaggtttaatactttcagaatacctcttcaatctcctgcgcaacacgatcaggttcggcaccaggaagatctattttgtttagtacctaaactagaacaagtcatctgtcaaatagaaagaattgaaaatctgtagcagaatgtcacgtaacagttaaagatttaaatgttttcatctatagcaaaatgaaacatgaaacagatgctccactatgttgcagcttacaagctagtttgcagtattgtccagttgaaaagggcaatattcacctcaagcagtatacattagttatcatccttactcagtttacatccagttaaaaataaggcaaacatgcaacgttcacataaaagttaactcgaacatgaaaaccttaggcaaaaccaaatatgtacgaatttgttagcagtgaaaagaaaatatttgtaaaagttagaaggtaaggaacctgttagtgtgcctataacgtaacaattcaaactcaccggtatgatttcaaggtcattttccagtgcaagatacacattcgctaatgtctgggcttcaacaccctgcatcatcattacatatctctcaacatgtcagaaagattaactcgaatatggtgaaaacatttaggtagcttctataggcaaatgttttcaaatacatagctattgaaacttacaggagggtaatatatattgcacctgagaagcatcaacgaccagaagtgcaccctcgcaagcagcaagagaacgggaaacctagtaagcagtcagacatttaacatgatgtttcaatcaaactccaaatattgagaacatgctgataataacagagtatcatccaagacactctgaaaggccttagaagaaatttcaataaggtgagaccttaatgcaatatgttggtcttactttaaaaaatatctttgttgttttggcaacagcatattatgtaagagatcaaaatggaagtagtaatgctatacctcatatgagaaatcaacatggcctggtgtatcaatcaaattcaggcagtagggctcatcgttcatgatgtagcgcatccgagctgcctaaaagaacaaatgattatatcgacggtacaaaatcaataagatatggaacacctaatatcaagagcatgctaggaaacttcagtccagatgaaaattaaattacaataacgatgtaagctgacaagttgtgacaacatccagtgaaaaaactgttagttgacttggtgcgaaagcgctgccctcttcttgactagtgttgatgctcattcttagttctaatactagtaaacctcggagcaactggccaaaatttaaggaaacaggaaaaatatcgtatggtagctaatttcaagtcatttctctctagtatctacatttatatcaagtaattacttctttacccaatgtaagagaaggaacaatgagttcacataattcggccaaatatattttttccaccaacctgcaatttgatggtgatccctctctccctttccaggtccatgttatccaggaattgctgtttcatctcccttttctgcaccgtccccgtgagctcaagcagtttatccgccagcgtcgatttcccatggtcgatatgcgcaataatgctgaagttcctgatgttcgaaacgggaacctagtagagcagaacaccgacgaatcgagatcaatcacaacagcaacgcacttgaaacgaatatcggaatcgcaaactctaccctgaatttcgtgttcgtcactcgagcaagcccaaaggcgcgcctagacctaagtgatactaacaagcgaggcgcgcgatggggcgactaccttctggaggcggtcctggccggcgtcggtggtggacgccggcgaggaggcgggggcggcggggcagacgacgcggccgcggggggccgcggagagggcgcgcgggcggggcggggcggaggggagaggagcggcaggcctacggcgccccggcgcgtgcggcgacgtccgcggcgccggcacggcgaggcgggaggcggtggcggtggccatgggaggaggaggagcgcgcgagcttctccgccgcaaggttgccgcgcccgcgctatccacacacgaggacgagacgagacgagtcgcatggactcgtgggtttgtgtagccgttgcgttgcgggccttgcggctctctccttgatgggctgggctgattttgggagaaagcccataaagtaaatgggccgcacgtaattcgcaaggaaataagtccatgtcaggtctcttaattattatgagtcgaatttgactcacgtcctcaacaacaaaacaagtgtccctcaattatcaatgtgccacgtcaaaaagactaaaccatcggggggactcgatttgcactgattttgatgattaagggatgctttgtacttggtttttggatcgagggggtacaaataaaagggttaatttgatccatataattgcaaatgtgcctattcagataaatactattacagttcatatatacgtagccgtgccattcaaattttataaaattaaaaccatgccattaccatcacgtttttcatattcttcctaaactgcgcatgggatctatctgtcagatgactcaattcatcttcttcctttgaccctcccttatcttcttccatttaacctttagatgagcacattatcgagctctgttcctttattgaaacggaaagttgtgtgactttgttggcttcttgtgatttagcagaggaatatcaagtatccaaccatcccaactagtacttctaccatctcagaaataatcagtctagaaatggatgcaacattatgtcaggatcccgggtaggccacacacgggctggtcagcccatcgccatgaggcccaagcaaacggaagggagcagcatacaagcagcagcgtcggcaacaccagggggcatcaaaagatcatttggacttggcggagctgaagctcccggtggcagcgacgacttgggcggccgatgggcaccctcgtcgatctctctccctacctctcctccgatctctagccttcccccctcagttttagaagtttctagcacttgtattccatagcttcttcttctcttgtccccaaaacagttgttgcttctatggtggatgcttgttgttgagttggaagtagtgggttcctaacaatctggtatcagagctgtcgattcgtgggatttctagcatggagttgatgggagagtactgcagcaacgccccatgcaagtggttgttggatttgggcaagggtggtgctcatgacaccaacgcccacaacctgttcgatggaatgcctagccaatctgagatgtccaaggaagatcagaggacatctaagcctgtccccatcaattctaccatgaacaaagaggagaaatggctggacaaatctctagatcggatattggagaagtttgaacaaatggaggccaagcgcatgcaagaggagtagatcaatcggatatttcaaaagttggaagatatagaggttcgtaggagcaaggcttccgaggaaataattgcagccatcagggcaaccactgctgttctcaaggctacatcacctacagcacccatggcaccacctactccagtgcctaccaagtgtttgacagaatgccccaacaacagcttcacttgggcaacagcgagttcaagtcacattggtgaggatactgctccaacagctacctgggaactaggagacaataaggacaagggccacgccccctacatcgtcaccaaggactcacccgaggtcacgcccaccatgtgttcgacgaaatgctccggtcctaccatcgagcccgatctcactgtggctgtagtggttacgtccgccaccactgccgcggcctctatggagttggtagccgctgggaacgcaatcggtgccactgacatcaacaatcttgaccaccccaaggtgacgcatgctaagtgttcgatgtttggctccggcgtcaaacggggcactgaacaagttgtgcttgcgttcccgcttatggctagccctatggagttcatgacatcattggtagaaccatctccacccacagggctaaagcttggtgatgccatctgcgtgggagattaggtgcctatgaagtgttcgatgaaatgtactgagagtgacaataagccactgatggaacaccccaagagaaacccatggccacctgcctggtcaggatggaagaagtgatatatgacctggactacaatcaatcatcatgggatgagattctatttcgtcccaccctggcctccaccaagtctagtaagttctttggcatgggtgcatttttgtgttggagctcttatacttcaaagggtggttttatcaaatgaaatggttgagttggagccctggcctccaccacatgaagcaagtttcagaattttgcctttccaaactagtagcaggaaatgttgcaattatgtcactgctttgagtataattgcatgggatgagaagaggacaaggagtagtagaattattgacagtagttttgaggaagggatacaggaatgttggaatccatatctagccttgccaatccctagctatttcaggaccagattgcaatggatgccaccttggctgccattagttggtttgctagaagctagagtaggaaagggttgcactactaattttgctgcaagtataattccttggaatgagcaaaagaaaatgatgactattgaaacttccacttgctttgagcagaaaatgcaccagttttgggctttgattttccaggtcagtttgacatcacttgctagcaaggaaagcaatctagttatttctgatcctgaatcattatctgtttggttatcatatgttgatctctggggatgttgctcaactactacccaactatagtggagaaatggaatatgagaataatttgcatggtgatatcagaatctgaatcatgtttggaatcaaattacattggtttgaatgttgaaagagatttgctatatgtgattgctgaagaaaaaggttgcaaaaggatgaaaggaatggaagcagacactaattcaattcatgatgagaagtatacttttgggttagttcctacaatggtgttgatcaagcgaggttgtcactgtttgcagcatatcaaattgttgaaaatcaatgttggcaagcaattcgtaacagtgctattgtcatgcatcacccaggagtactttacatggagtaagcagttattcaagctaaagctacttgctctattcttcttcaatgatggttcattgtctaacaccaaatatttggagcaaccatgggatccgggaggtgtattccatcggcttggggacaagccgaatttcaagaagggattgtcaggatcccgagtaggccgcacacgggctggtcagcccatcgccatgaggcccaagcaaacggaagggagcagcatacgagcggcagcgtcggcaacaccagggggcatcgaaagatcatttggacttggcggagctgaagctcccggcagcggcagggacttgggtggccggtgggcaccctcgtcgatctctctcccctacctctcctccgatctccagccttcccccctcggttctagaagtttccagcacttgtatttcatagcttcttcttctcttgtccccaaaacagttgttgcttctatggtggatgcttgttgttgagttggaagtagtgggttcctaacacattaccttgctagattcattgtactaggtagtgtcccatccacttttaggttgattttttctggaacggagcgagtatccctgaagagcaatgcagcacaagtcatctctcggattgcctttagtgtattctttggagttggaatgttgtatttcggccatttaataattgtgtatctttgtgtgagatgataatgcatatatgtgtgcgcgcgcgcgcgtatagttcagcagagtagctgatctgactcgagcttattagtgcaagcatataaatttatagatcaagcttaataagtgcatagagtgcattaatacacatcgtgaaaaatgtagatccttagttaaatgccatctccatcctgattaaattttgagtggatcgcagtttagacggtattttattaccaaacttcactttgtatcacttatagccatttggggttgatagttttaatgttattttatccatttacatctagcttttcatcattcagttaaggtgtggcctatgctccgggaagtccgttggcatgcaagagtcaagaagattcaccgcaaaattaagttgtgcggagagaaaatggttggataaaagttggtccaatgtgaaatgttattaacacaagtatttattaaatgtaaaatgttattaacacaagttggtaggagtatcatttaaaagttggtccaatgcgaaagtttatgagcacaagtttttaccgatgtttcttgtaaatcaccttttatatagccttttcactttagactaggtaactaataatttttgtaatttggaccatccaattctttcatatgcccacatattcttattgccaaatgttgaccaaacgatttagttggatggggattaatagaatagtttggtggtccgaagcaacaatgataaaaaatatatatcataaatgagaaaagtcaggttagaaagctagtacaaaggtacaaatttcggtaacaaaagcatcatatattcaccaggcgactaaaaatttcataaatgtcaactggcttttaatagttaagattgctttacgattcgtgcagaccttctctcctcgctcccttctgccaccgacaatccttccaagtttgagggccccaatcgccctatctctgccactacgatcctcacctggaatctaacccggtgcgtcgccactatattgtgcacaaatcgacgatagatagattcgactagttcctcctgaaaacaaactattatcgaagttggataataaaagataacccaaacattaattcagttttcaatacataaccaatttacccaatcagtaacggtttgagacatttagtacacgaatcgggcatatcagatagattcaatttctagttattcctgtcaacagacgaattgcgaagctggaaaataaaagataacccaaacaataattcaaattttaatacccaaccaatttaccccaaccagttggtaccatctgagatttttggcatgtgtttggtttgggaaatgctcatctacccgtttagcatgagggatatgatggtcataatttccaggggatggctcacatatcaatgattaaaaaaaagtggattgaattggtcctctaatttttgatatatcagtccaacccagatattaagggagtatttccttttagggataatcccacttcacgtcttcacctattccccaaccaagcacaatgaaaaatgattttgactcaacccgacctattaaaggggtgtttagatccatgggtgtaaagttttgacgtgttacatcggatatacggatacatatttgaagcattaaacgtagactaataacaaaacaaaaacaaattacagattccgcctgtaaactgcgagacgaatttattaagcctaattaatctatcattagcaaatgttgactgtagcaccacattatcaaaaaatggagcaattagggttaaaaaattcatctcgtaatttacacgtaatctatataattagttaatttttcatttatatttaatactccatacatgtctctaaacatttgatgttacgggtgaaaaatttttgtatgtgtatctaaacaggccccaacaagcagtccttatcatcagcagcctagcagcaagaacatccccgtgggtcccacatgcagtgacacatgctgccatcgaacccttgcaccatttcctcctataaagccacccaccacatcccatgtccccgcaaagcgaacactgccttcgccggcgaacgtccaatcatccaagccaccctcgccgccgccgccgccctcgttttccggccatggcggtgacaaagctcaacccatcagcggcgccgttccactgctcccgccgccacctgttcttcgcgccgccgcctcctcctcctcctcccatgccggcgtaccagtaccacgccacgggcgcgtgcgccgcggcggcgccgccacctttccccttcttcgccacctactcctgcgcctcgctcccgttccacggtcacctctacccaccgtgcgggtaccaggcgcagatggggcctgcgccgccgggcgcggcgttcgccaagggcgtcctcgccgcggcgccgccgccgccgcacggccgccctccgcacaagctcatggtgtgcaagggcgcccccacggtcaccgacgtgaagctgcgcgcgcaggcgcgggcggcggcgcgtgtgggcgttgccgccgccgtgcgggggtggcgaccggcgccggccaccgcggggcctccccggatgctggtggccgccgcgccatgcgggatgctgcacccggccgccgtggcgaggcggcggggcatgagcaaggtgtacaagccccggaagccgcagcgcgccgggagggagcggtcgccgtcgccgtcgccggtgttcacgacgaggccgatgtcgccgacgccgccgatgcagaagctgaagccggcgcacaccaccgtcatggtgcgcaacatccccaacaagctcacgtaagtgaaaccgccatgccctcgccacgccacgccacgcaatggcgccatgccatgcatgcaccacgtgcacgccgccgccatctctagcgcacctccattaatgtctcgttttgtggcgcgcgcgcgcgcgcgtgcaggcgctcggacatggtgcggctgctcgacgaccactgcgcccgcgagaacaggcggcgcggccgcggcggcgagccgcgcgcggagtacgatctcgtctacgtccggatggatttcgggtgagcaaacgaaatctctctcgtagcttctttcaaaatgaaaatgtctcaaaaatattccattactccgttcttgcaaaaaaaaaaaaagaaaactgcgatctttcgtgcaaaaaagaagaaactagtgcggtagtttttgaaagaacaggagtagaggaaagaagtttcttttgtctccattgtacattttgtaatagtacgaaaaaaatatcatggtcagaaccagttgtccttcttcaacagtgaaaaagcaaaagaagcaacaagacaaaaccccaaaaaagaaagaaaagctggtgacacagcaccaaattaaatctcagcaaaaaaaccagctaataaatccatttccacaactagcaaatgtacattgtactactactcctatactacactcaattcgttttactaattctgagctgtcattagacacatgatctaaagctggttgcgtttgggctttttgtgttggcgtttgttgcaggatgtgcaacaaggagaggagcagcaacatgggctacgcgttcgtcaacttcacgacggcggaggcggcccgcgggctgcagcgcgcgctccacggctgccgctggaagcgctccgccttcgactccggcaagatcatcgacatccgcgccgcgcgtatccaggtacgcaatctcaatccgacgcgacgcgacgagacacccagatgcaatcattcgtatcgcgaccacacaagatcgtactactgaaaatatactgatatgatgtgatatggtgttcgatcgtttgttgctgatgagttgtgcttttggttttggttttgcatttgcaggggaaggacgcgctggtgaggcactttgggcggacgacatactacgagtgcgacaccgacgagtacctcccggccgtgttctcgccgccgcgtgacgggtccaccgccggcgccggcgcgccgtcgccgccggcggtcaagaccgtcggcatccgtgtgccccctcggccgatcacgctgctcacccaccgcggcaacgtcaactgatcgatcgaagaaacgatcgtgctcgtgtcgatcgatcaagttcgtgtgtctaccgtctcgatctgagtcaaaccaagcaatgcaacagcaggtagctaggtcaggtgactagtgacagtagtagtagcttcgtttttttcgtttagctcgttcgttcgtttttctcttcttgtctcgtgccggtttagtggtagagtggcacggtcaaatccgaagtctaggcatgccttccctttcccattcggtgcaatgcaatgcaccggcagcagcgaggacgggaaggctgggagactttggacaatagcgtagtactaccatgtactgtgtgctcttctttgctctctctctctctctctctctctggtctgtactacactctgtagcatgtgtaacgtggtggtagcaatgtagcatgtctcgattcatgtttctttgtctgatgatgagagagtgagttgcttgggtttgttgctgcagcttcatctctgcctcttttttcttttctctgcgcatctgtgttgcaatgcaatgggcagtttggcacgtagtggtactgcatgtgttttgcccccacatctggtgcttccagggctggctttgccgggctttcccctgcctgctggtcctgtgtggtgcaactagaagcagcccagcttgtgatacacagcttggtcgacgtgtacaacgtgccaggaaagcagaagaatctctgccttgcctgcacctgttggcttctactactactacaattcggggccgccattaaaggggtgcgcaagaactgcacggtcaaacagtttcctcttccatgaaaccaaagccccctctcgagaaaaaacttggtcactctcacagtctcactcactcggcatgcatgcgttttgcagttgcagctcgattcatctgcttctgcacatcgatctcgatctcgtgtagcagcagcatcggcatgtttgtccgcttgcttgctatccgagtcgcccgtttctctcgatcgccgtttcctcctccccccctctccatatcgcacagagtcacacggatcgtagtataggtcacaagcgagcagagatgcatatgactctctcttcttcttcttctttttctcttcctttctctcgctgtttgtgttgcaccaacaagtgaaaagcagcggctgcatgcgatttttccaggacggggtttgcaggaggaggcagggagggaggcagcctttgtggccgcagagtttcccgaatgcggttgatcccggggacgctttgccgaccccgtcctttggccgggttggtgaaaatgtccctccctcctgctacgccgtagccagcggcaaaaggctagtagtagtacgccgcagcgcggtgtggctgtggcgcggcgtgcatggagaaggggggcgtgattttgcccggttttgacgcggaaatggcgtgatttttgcccggttttgacgcgggtgctcgtgcacgtaacaccatgcagagccgcggcaggggttggggttgggtttcagttcaacgttgcaatgatcgctcgctagcctatgctaccgtggtagtactaggagtacgagttgttcgttgctgatccagcgatccttctcgcgtcagagaggcgaggctgtagattactagagccatgatgatccgtccgatttgagtcgtgacatgactgcatgtacgtagcgtgactgtgcgattttgtgattgttgttgttgtgtgtgacattttgattttgagccgtggcagtgactgagactgaccttgagagagcggaacgaagccaagaaagccatatctgttgtcctttttgcctttctgctactgtctcactctccggacggattgtaccgccgcaccactccggacggactgtaccaccatcttatggttctgggcttggattttcgtttactcgctctttaatttcttaaagataagttctgtgaaaaaaaaatctacatatatttttttcttctacttcctctatcccatatatcaagttaagttaatttagtatataatgcgatatattggatagatgaccgtctagattcatattttcatagtattacgatgtctcatatttcgtacagattaacttattttggacctgttcggtaggcctaaatatggctgcaatacagccagccgcaacagtgttgcacatataatctcaatggctatggtagtagctacagttgcaggagtattgcagccgaacaagcgaaggaagtacataataaagtaactattcaaatttatagtagtacccttaaatagctatcgcgaaaagttagattgtccattaattcatcaatttcacctattttgggcctaagtaggagtattggcgatcatttggaaatgttggcattttgtgacggagtgaacattttccaaccttccgattggggcagttctaccactaccttttcaactttagtaattttacccttatttttctaattgagcatgcatttgacaattagagttggaaacagagataagaattcaaataccccaaacatgatcgaattcttctcctcttgcgagcaaaatattaccatgcgaagaaaaaaattatacacgacactgggtcaacatattgttggttaggccgaaactgtccataatccagtatcaatgctaatggttcctgttacacattgggccgcaattcgatcccgtgggagtggataccggcccaattcaaagcccatatggtgcaccaaactattagggtcacattacatgcttacaactcatgtctcttctgctgctctgcacgccattcttcgcggatctgtcgcgcatttctcccttgatccccttctactagtgctaatccattgagatgagaggacaattggggaggtgaaatgaattcaaagccgaataaatgagtttacaagatcgatatcattatctccaggatcatccatgccaatctacgatcgccgagagaaatccgctgccgaggacagggctgagactgacgaattgtcgtgcatcacacaaagaggtttgaagtgatggtttgttcaatctgatgtctcagtatttgaagggtattaatctgatctctatcaacaaaatgttcagccaaatctgttctgtttgcagtttttatttgttagtattattcattcctctgttcttttttgttggattattaactactcttcaatttttcttgtcaacgtaatctgaatccccaacccaaactgtaattttttccccgtttgcattaacacctcaagtcctcaacacttgtatcatgactattgtaatgcatttcgatataattacatccaccaagcaaacaaaattcttctctctcattttctttctaatcccagtgtattccgataacgtttacgttacaaattttgaaccaaattttctcatcttctctaccattttctatctattggtacaactgaaagcagcagcagcagcagcatcccccttttggatacagagatgcacgagagaggcggcggaaataccgaattttactcacggtttacatgataaagttattcacattatcacataagaggagtatcaaatcctgagtggtgaaaaagagatagaagaaaacgaaaacaaaaagaaaaaaagaagaaataattatccgtgtctatggaggagatggtagagagcttcttcgcagtagcagcaatggcgatggttggattggagcacagcaatccagtaccagttcgtcggttcttgctgcttgctggttggtcgtggtcgtggtcgtcgtaggctagagttcgccggagattgctggagacggctggtcgtgtgcaggctagaggtggagcagcgtgtcgcagcgccaatccatctcgtcggcttcggcggcggcggcggcggatggggacgaggccggcaggttcagatcgaacggcagcggcgagcagcgcggggcggcggcctcgtcgccggcgcccgaggcgccgtcctcgcagagcacggaggaagaggagccgcagtagctgcggcagtcctcgtcggcggcggggttgctgccgccgttgcgcggcggcggcagcccgagagctccggcggaggcggccgcggcggcgaccgtgacgccccacgactcgaccgtgctgctgtggctagacgtcgccgccgccgccgcgggagggagatgctgcggcggctgatgctgcggcggcggaggcggaggcgcggaggaggaggtggagggggggaagttggtgcgcgcggcggcgccgcggagcgacctcgcggcggcgtcgtaggcgcgggcggcggcctctgcggagtcgaacgtgccgagccagatcggggtcttcttcgccgggtcccggatctcggccgcgtacctccccgacggccgcctcctcaccccacggtacctcacctccccttcccccacccccacccccgccatcgccgccgccggcggcagcctcgccctcctcatcgcgatctcctccgacgaggcgagtagccctcctctctctctgactcttcctcttcctctcttttggctcgtctcgtctcctcctccttcgcctcgagcacctcgactatgcgtgcgtgcccgcgctgtttggtcggcacgcccaccccgtcccggtgtcactgacggggtggggcccaccacgacccgggcgtcggtttgttttatggcgcgtcccccgaccgcgtccggggcgtccacgtcgcggggccgggtcgcgtcgcggcgtgtttcctcatccgcctcttggggttggggttgggggggtggtaaattgtgggggcgtgtgagcgagggggaggggcaggtgtggtggtggaggtgggtgcggatctttatcgtggcatatggtccggaggagaggtggaagggtggaggaggtggtcgtcgcgctgcgtaccactagcgaggcatattcgctgcgccctgccggcctcgctcggccgtgcacctgctgcctgctgctgctggctgccgtgcaggttgtggagatgatcagatcagctgggatcttcgagttcagactttcaggcctgggggcttagggccgttttggattggattgaacccaaaatgttggattgaacccaaaatgtgtctaaccaaaattttttggtaacttaaataataaatatacgtttagatttaagttaaataattaatagtggccatgcttaatttagccatattttaaaatctggtatcaaaccaaacataggctctgtcctaaccaaaaattggtagtgtgtctagtgttaaaaattgcctactactagattttaacactaaccaatgaattggtatggtagaaaaccaaataggctcttccttttttgagtttttaaatctagatttaaatctaagagcttaattttaaatttaatgtggaagctttttcatggcgtttgattacctagtattgccttttcaacaactatgattagtttatctatggccagggtttctcaaatcgtcagtaaccgcgcggttaccggcgttactgcggaggtacggtaatagaaataacgtggtacggtaatagaaataacgtggtaacctccttaaattcaaataaatttaaaaaataatttaaatttttgataaattttgcacagtttcatacggtttttcacggtaaccgtgcttaccaccggggcgcggtaacccccggccccgacggtttgggaaaccttgtctatggctcataagttgtgaaaaaatatattgttataaaatttacgagtaaaacttttatatcggtctaaaatacaatgttgaaaataaattaagatgagaaaatttcaaaaacaaatcggtcttaaataagttttaaattttggttatggctaataaaacaacaaatgggcgatgagaggctagttttctttcgttcactcgtttgtttctttgttacttggatcctgtgtcttcgccttgtaatccaaaataaacacgtcacaacgttgtgtccaatagcgtctctgaatttggagacattcacagagcatttgcaaaagatgggcaggtaaagtagaaaaccgtccatgtctcgccttgacaacatattccttcatcatcaggtgtcactcacatacagtgtcacgactcacgaccgagcggggtcatctttatcttacaactgacgagaggtcagcgggctcactcgtaagggttcctgaagttcttgaggagctccgggatgtcgtacgcgagcatgtcgtccacggcctgcaccagcttgggcttcatcttctcgaacttgtcgatgttgtacccacccaacacctccttgaagtgctcaacgtcagggaagtctccggctggaagatggtactccctttggacctgttccagcagtttgaattcagatgcaagcaggtgaagattatggaaaaaaaaataatgcagttataagatccattttatcactgcggttggaaatgagcttcttgtgatgaatatagatcgaactatcctggcaattaagttgtttgtaagtactactagtacctttgcaaactcatcacccaggttgtctatgagtcgctgttgagccttagctttccccatcattgcaggcatctccttctttagatggccaattatgtaagcatgaatcttagcagctctagcacgtttaacaaactcgttgacctgcaagtacaaatggcgacattcattgaaaattcagcagttgaaaagaaaaaaaaatcagataagtgggagagaacatcatacccgacgatcacaggccttcttgggtatgtctttcagatcacagaggagatcatcttgctctttctcaaacaagtcctttccaattggtccaacagctgattcattcactggtttgtcattgaatgacctgcaaacattagtttcagagtgaatttcagttttcaacaacctccatctaactctgagagatttatatagtattttgctcatataattaaacagtcagttactagcgatgcttttagacttctaaaaatattctaagtacaagttttatgattgatacaggaattatacaacatccagtcagtcagtcagtcagtcaccagaatcaagattacgacagcactataaacagaagcaaaagatggggtgttaaataattgaagatgtaggaatttacccgatataaacacgcgcgacctcaggggtattgagtactttcccaagagaccacatcagtgcaccatacactctcataagctgcagcatgaataaggggattatgtgattctgatgcacaacatagcacattttaaaacagaatatggtgtaacacttcccgtattgattgcaaggaaaacctctacctgctgagtgtcaacttggtctgccttattcagcactacacgtattttgtcatcatggccacgtaaagatgcaatcacacgtttgaactcatcactgatatcaagcttatgaggatcaaacagaagaagaataaggtcacacttagcagcaaaccatgaagttatgccggtgaaatcatagctacgctgcgtccgctgcttttcaccagacaggacaccgggggtgtccacaaaggtgatatgatcgagcagcttcatggaagaaaaaaaaatggcttgtatcagtttgtgcaatgaatgtctttctgtatgtgttaatatcaccaattgaagcttaccggatgtggcatctgagagcactcgaactttgacagaaaagcaccgccaaatgtcgtaagaccagtgaatggcatatcagcttgaacagcaatagtattgccaggaatagtcctttcatcagatccagactagtacaaataaagaagaaaaatgagagactaatgggatcattatgtagcagcctaaacaacattgtaaaatcaccaacagatttcagaagccatatttttgctaacaacttaaaaagaatcaataaatgttctacaggtgtgcattgaatgaaactttgatgaaaacctgtagttccatgatgtaaaatggataacaatagttgtgtttttatccaatgtgtgctgctgaaggcaattcatccaataaataatcttaacagctgtagaaaacacgatatggtatatgactagtccacatgtgaaccattcaacttagaagaaagggagtataatgtatgccacccttgcatcttacaaccgaccaacctgatattgtcaactgataaactttttaatctattgacaatgaatgatgaagcagctctaacttggttttttttcttttgctgaaatacgaccaaaaatggtactttgaaagcacaaaatatattgaaaacaagagtatacaagaaaacaaaatcaatcatatgcaattttcctgctttataaaagatcccccatagttcatatgctcaagtaatagctaactcgatatcactgatgcatgttatattaaatactcatgttaacatttaccatgacaacaacaaatcggtcagtagtgggctctggtccaacatgagctcctgcagttgaaagggaaaaattaaagttatactctgattatattagaagagactaacgttaaattgtgcagtgtggctaagagtggaactgaaatattatgtattactacactattagttcaatcacagaacctggataacttgtttgcagcagatgcttaatgaaagttgttttccctgtagaatattgacccaagagcataaccattggttttgcatcaaaatcactgcttgtctggaaaatggtacaattaatgtaatgatatgtgagaaatagagcaataatccaattagcatgaaagtattcgatatattttcaataaatgtgaaccatccataccaataacggggaagcaaaatcgttgaaccggtatgcaacctccagaggcttcagtttttctacgtatagtctttttaagccatcaattacagaagtaacagcagtcagggggacctgcatctgcggacagaatgaaggtacaaaatcattaaattgttaagctgcagaccgcagtactaagaacatttcgatgactcaacaataaactataagagcaagaaaatgatattagccctgaagataaacatgataaaagtgcacgaaaatcctgaaacaccaccacgtaagtctagtaccttctttgctgattttgaactgaaccagctattagcagaatgcacttgaacctgaggggcgcctgcacgacagaaagaagttagcatcacagcctactcatcactgacatcattcaccaggtggtacccttgggagcacatttcttaccattttcttctgggtgtactctctttaccccagcctttgatctctgaaaatgccattgcaacatcacagtgagattttgaaatgcgtcagaattacaccaaagccatagattgtaaacttaccgcaagtagttcgtcaagaccttccatcacaggtggatccaaactactcaggtctgcaagaatcaccataaattcaggggacatccacacaaacactgaaatacagatcgcagcatcgcaagagaaacaaccttcgcgcttcagactgtcctgagtgatctcctcccccgcttgcgccagtgacacgagctgcatttgcgaatcgcaacagaacaacacaatcagaaacatcctctcgaatcagcagcagtcacagaacgacgaactgtaacggataaaggaagaggcgaagtggaagcaaaacctgcatcgcggcgacgaactcgccgaagccgaggaacccctgccgcttggtgtccgcgatcgcccagaccttggatcaacacagatttatcaaaaaaaaaaaatccaaaagaaaccacccgactcaaacaaatccaaaaccaactcgcggcggcggcgcacctgcttgaggtcggcgcgggacaggccggacatggcgaagaacttggtagcatcagcacccgtgacacgcccatctccatctacaccacccaccacccaccaccggcgaaccaaaccatcagcgagcgattctggggctctcgaagtcacacacacagagagatcgagcgcgcgccgaggcggcatacctgggtcggcgacggcgaaccagccggcgtagatcttgtggtgctccttggagcaggccgatcgcgcgagctccatgcctcgtcgcggcggcggcggcggcgaggaggaggaggagcagcagaggcggaggcggaacggaaacctgacgaggtgggggtgatgcggggtggaagaagtggaagggcgaggcatttttgaaaaaattcggtggggcccacctcgccacgctcgcacgctcccctgcgatttcttttcggttttttaattggagcggagacaaaacggaaaattttgaacgagagaaattggatttgaatccaacaaaggcgtgttgatttttgtttgggctgttgtgccgctgtgggctgtttgttccccgaatgggctgaatttgttggattggttttgtaagtcatcgattcgtggaataagttcactctaggtccctctatttgtcaccctcaaaaccgggtacaacccgtccctcaacttatgaaaaccgggcaaacgaggtccctcggaggttttgagggtggttttggctgacgtggcgcctacgtggcttgtttaactagttctccgtcccacgtggcattgacgtggcgcttacgtggcattatatcttgaaaaattaataaaaaaacatgggaccacctgtcagcggcacaaatttttttttaaaaaagcgggcccacgtgggccgacaagtcagataataaatatggtgggcccacataggccccacatgtcatcctcagcccccctctcttcttcctcctctctccccatctccctctcttcaactctctctctctcccctttcctctcgtggcggagaggcagcggcgctcgccgcgcggcggccggcgggagaggaaggggcggcgggaggtggccctgactgccgcagccgttgagcccacagggcgtcacgctttgtcggcgagcgcgcagaggagcgtcgacccggcggcgggggagcggccgcgtcgtcgtcgtcgggtgcgtcgtcatccgcggtagcgccgccgaggcaagcggagctgctggtgcggtggctactgcagccagccgacttcctccaccgatgaagcgtcgacatccgccaggctccgcggccacagggtgtccccatcgtcggggggatgggcccctcgccggcgcccgcctctccacctgccgaccctgagctcctccgcctacgccgctgccagtcgctggatctcctccatcctctgctccaagccgttgtcgggtggccgaatcccctccgagcctggccgatggggcctcgcctcctgctgttcgccggggcaccgaggacgacgctcgtcaccggcctttgctccactccacagctggtcgccaccgtcgaccttcgctcggccgggcgcggtccactcctgcgtcggcacggcgggagcgggagcggcaacaggggaaccaccttaccccgagcggccacggcgggtcagggaggtgggcagtgccgccggtggccgggctgcggcggcggttggggtcgtgtcgtcgccttgtcggtgagtgccggcgggcgcgggctacgaggatgcggtggaacagggcggtggaggaaaagtgggggagagaacgacatgtggggcccacgtgggccccacctttttataatttttatgtgaaactgacatgtggggcccacgtgggccccacctttttataatttttatgtgaaactgacatgtggggcccacgtgggccccaccttttttataatttctatgtgaaactgacatgtgggtcctgcgaggtttatttatttttcgggttgaaaattgccacgtaagcgccacgtcaattccacgtgggacagagacctagtcaaacaagccacgtagatgccacgtcatccaaaaccgccttcaaaaccgccgagggacctcgtttgcccggttttcgtaagttgggggacgggtcgtacccggttttgcggtcaagggacgaaaatcggactaggcgacaaatagagggacccaaagtgaacttattcctcgattcgtggatttggtacaaattgaattttgtagactaaaatcaagtggtatattatctctttttggtacaaatgttgacaaaccatcactttattatagtcttagcatctctgactccaagaaattttggagcaagatacataacatgctataaaaggcttatgcttatttggtatcaaacacacatctaaaagtgaaaaaaaaagagaaagtaggaaaccgccaatacttccgatcaaatcatcacaattacaagggttgtaaaatgacttttaacctactttatcgttacatatataacataatttactattttactcgaataagcgtatctcaactgggtaggtttttggtgatgaaacctatccaccgaattcaactcgtagacttgacacaagtgctcatatttatgactaattattctttcagtgatagacgatctacccatcaagtgcaaggtgcctcttatctcttgtggcttataccagtccaatctttgaaaggaaatgtccgtgatggactttatcaatctcaaaacatgttggttcaatcttcagagatgttcatagagatagggtgtgccatctattcatagaggtgagtgtgtgcatgtttgtgggcgtctacgttatactgctttttgaaaaaaaaagaatgtaatactccatgtattcatccgtttcatattataattagcagtaaaacttatttaagattgactaagtttctgaagacgtatagtaacatctacaacatcaaattagttccattaaatttaatattaaataaatactttgataaaatatttggtttgtgtaaaaaatattgctatgtttttttataaaattagttaaacctagaaaatttgacttaaagaaaaaaaaatcaaaggaacccgtaagaaacggagggagtaatatttttacaccatgagactaaagttttgagttatgatgtggcttcatcacggccttaggatggaaaatcaagggctagaacgcagcacaaaaatcactgcggccaaggcggaaaactagcggtgtcactgcggccggcgaaggcggaaaaagctctcaaccaaaaccgcaaaacccttatccctcctctcctttccttccccccaaccctagctccacctccacctccagccatggcgggcaattgatggtaagcaccgcgacggaatgttcgcagccggcgactcagcgttgttctgtgagttttttaggaaaaacaagtaggaaatgaaaggttcaatcatttagtggttgtacttctggtcagacaacacctatatattgcaacccgggatttaaaggggttgtaaaccgggactagagagcccttccccagtagtgtattgttcttcgtggtggcgcagaccaggtatttactatgacttatcttcttatatatttagccaattctacgaaaccgaggatttaccgtattcaagttgtttgcattgtcatgctatttcatcgaggaagctgaaagaagtctacatggtgccatcattattgtgagtagagctgtcaagaacccaacagttgtgcctggtggtggtgctatggacgtatgccaacttgtcaagattaatggttccatctgtcaagatgtagtaagctgatgttgcagttctattttttgttagatggaagtaagcaagtatctccgacgacatgcaaggacgatagttgtgaagtctcaatttttcgtacattcatttgctaaagcccttgaggtatactcgttctctttctcgcgcgcgcgcaactatttgtaatttggtatctgatcagagatttttttactgtccttgagcctgtgcagtaccagatcctcgctgtccatctagcccaatccaatggctgagacagcctctataccgcgtggtactgtagaatcgatagatgcggtaccatgagtgggagggtatttttgtctttctccccgcatcgcacgcatcttgcacgttgatctcctagccgtcgcacctgagcggctgcatcggcatcggcaccagcgccgccgtggtgcctcgcatgcagctactagcaccacgggagccgctgccgcacgggcccctgctgttggtcgcaaagacggccaggaactcctcgtcaagcaggcgaggtcacagttggcgtcatcttcgtcttcgggcctgtttggcacagctccagctctagctccacccctcctggagctggagctcagccaaacagtttcagctccaccaaaactgggagtggagttgggtggagctctctcacaaaatacactagagttgtggagctgggtttaggcagctccacaactccactccagacttaactcctggagttaaatttaggagttggagctgtaccaaacaggtccttcgttggggccacaacgaacagcgaatagcaaacagaaccggcgcgaggtcgcgatggaaggggatggaacagcgtccgatggaaagtccttttcaatttttcatagctctttgtccctgttcctgattattgattttggtttctgtcagtaaatttgacagccaaccgatgaactgtcgattaattgttcggttgtgtccacgtatacatcacttttttttgcaaccttacacatatacctcacattttctcaaacacgttactggacatttaacttctcgctcattcaaaatgaactcgtcagccgtcataccggttattccaagacaacttcatggcagtgctggattcactgtttctccctaagtagcaaggacttccattcactgttttaatcaactcgactaaaaccttcctaactatcatgatagtgctggattccagattcgatctctcaacctgctcatatttcacctggattaaataaagggttgaaaaaatatctagcttatcctatcttaatacaattggatggctaactccttctagccatcccaacaattttttttaagtaaaaccatagtatcgattttggtatgcactcgaaaaatgatagtggtaaccttcctaacttgcctcttatgctgtagttatttcagtaaggtgatgaaaaattcttgtcaaacagattaactatccccggatcacctttgaacaacatggttttccgcgtggaatttcattgtttgtagcaatgtctttatcctggttctgtcccgtattcaaaaccaattcctgcccatacttcaacatttaatattgactaacataatacatccctccttagtacttcacccatttcataatattcatatggatgtggaaaatccatatgaatattagtgaatctagacatacaaccatataaatatgaaaaatattacaatgacttagttcttcttatacaaggcgaagcaagctgctagcgcgacggctggaccgtggtgattctggtgaaggtgccatgcgaggtcgcggtcggcggggcacgcgcaggcggtaattctgccagcatcttttggggtttctttgtgcggcatcctgcattacttctatctttaaaaaaatctatttttttacattttttttacaaaattctaagagcaagtttaatagtgtagcccactattagctccaatacatctatagctgatctaatagcctattcatacaatagttgcttactatactattaacatatggtcccacctgtcatacacgtattatgttttggagtccgtgctgcagctggctacagatctgtagcctgctgctcttctctattatcttttatatcattaaaatatgtttatagctggctaatagtctgctattgtacctgctctaaacatagcatatgctcatattcatggataaataagcccaaattcatgtataagagttattcttttataaagggtacaaccttccagtttttctctgccaaatgccagagtttttgttcttgggccgtgtttagctctaaacttttttttaaaacttccaattttttcatcacatcaaaactttcctacacacataaactttcaattttcccatcatattgttctaattttaaccaaacttccaattttgatgtgaaaaacacagccttggtaaccaataagctagccatccttattgtatactccatccgtccaaaaaaaaaaagtccaattctagatatgtgactagattcatctatagaattagactttttgggacggatggggtattttgtagttggtgacagttgtgatacagtagctgtcggcacggatccgcacaaatcatgctcccctgccgtcagtaccactcagtttcattgtccattttaacacccgacacctgtgctaattctgggaccatgttgatgctggtgtgggctcccatcggatggactattcaactaaagaaaaagccaaaatttaaattttcaaactaaattttgacattgattttgagatatttttaacgtagtttctttttcagcattgacttttaaggcactccgaacacatatataaaagttttacctataaatttatttttattctattgcaggggcggcgcacgcgggtgggcgcggtcggcggccggcagtggacgagctgtctaggcttaggggattgttttttttttcaatttcagatctagagttgaatgctagccaaacacttagcttgttcccaactcccactggagtacgagtttagagttagaagttagagtttggagccctaccaaacggggccttaactattgtgattaggatcgtcttactaacgatgcatgctctcttatgacacatgttactactagtcattctgtgaaacttcagggctttcgactatgctctctcttcagtcttagtggttctaaaatccattatcacttagggtcatctatggtcattagctggcgttgcttcttttgggattttcttgggagggtagtgtgattttgcctccttcctgctgattggagttatgtttagcggtcgtagtagtctctttctttttttcttggtctggtcgatttagttgtgtaaacaaatactcttttcttttaatttattaatgttcttctaatatattaacgtgtaatttttttacgtgttcgcggaaattttatggtgaagacagaaagctaaagctagagatggaatctagcaagataagtgaacgtgcttaacaggatgcatttggtgacacgcagtgctcgtactccatagcacattgtttttgacgtgtgaccatttctttgcctcgtccatggattctacgtgttgctgtataggagaattcccatgcccatcaccatctcgttttctagagtgcacggcaaaaccgaaccaacttgcatataaatgcattaccatcggtgtatgctgactgcgttcggtaggcatgcacgatgcgcggtcttctttttgtcaatggatgcggtagtatattaggtcctggttttttcggctcacatattatgtaccagtgttatcaccggcatattttctaagctgcttaatggtactctttttgtttcatattaagtctttttgattttttttctttgttaaacttctttaggtttgactaaatctatagaaaaaaatagcaacatctacacacaccaaatttgtttattaaatagtgttgaatatattttcatgatatgtttgttttgtgttaaaaatattattgtatttttctataaacttgatcaaatttaaaagtatttgactagaaaaaaagtcaaaatggcttacaatatgaaaaaggagggagtatatttttttagaaaatcttttcttcatcagcacatttaggaaacggttttaaaatcaaatttttaatatttcgtacattcgcctctgttatagatatcttgaattattatttataaaccaattttacccctcatctataaagaaagaaccggacaattgtggaactgtggactggagtacaaccaaactgaaatagcgtttcgttcacaaatattgctagctatttaaatacaaaataataatttgtcgtggaacacgcatcatttttgcaaacaaatggaaagggaaattttgtatttatatgtagttgtgtaacatgccacctactccctctgtccaagcataccaagcattcggaatttatctgtaaatacaaacatttcaatttgcatctcatttttttccctcatcttaccctaaatcatcctatcattcaatccatataacgagggacaccaaatgttttttcttgcttaacctcaggtgttgttattttctgattaacatacatattttacctcaatttttgttagcatgtttttcagtttagcatgttctgtgcaaaaacttggctttaaaatatcaaataaatctatttttcaagtttataataattaaaactcaactaattaagtgctgatggctatcttgtattatgtgtgccaacttcattttcacctcaacatcactttaatctctactattaaccaaaatatgcctgtactacctccttttttttaatgtataactctagtaacttttcttataacacttaaccgttcgtcttattaaaaaaatagtataaatatataaaagtataagttaatattataatttcttggtaatcaaacaagtcacaaaacaaataaactgtatttatgtatttctttatttttaaataagataaacagtcaaactccatataaaagttaacgatgttatatattaaaaaaacaaatatagtatttgtagacaaaatgagtataaacttgtagctctcgttcgagctccaaatcaaaaaagctcccataaagccataccgctcgcggataccgcctctagttcgtcacctcgattagccccagatcccaagaaaagaacaaagcgatccgctccctcgcctcgccgcggcattttcacaagcaccctccgcgcgccgcgccgcgccgccgccgccgccgccgacaccgtcgcgagagggggtagggggggatgggctcgctccccgtgtcgtcgccggaatgcgcgccggggcggcgggtgacggtggcggcgtcggacctggcgccgctgttcggggcgcagcggcggcacctggaccacttcttcgaccggctcgacctctcgcaggcggcggcgttcgcgcaggcgctggtcgacgcccccggcgcggtgttcttcacgggcgtcggcaagtccgggatcgtggcgcggaagctggcgcagacgctggcgtcgctcgggttcacccgcgcggggttcctgtcccccgtcgacgcgctccacggcgacatcggctcggtcttccccggcgacctcctcgtcctgctctccaagtccggcgcctccgacgagctcctcgccctcgcgccctgcgcccgcgccaagggcgcccacctcatctccctcacctccgccgcatccggcgccgactgcccgctcgccgccgtgtgcgatctcaacgtgcaccttccgctgcaggccgaggtgtgccccttcggcctcgctccggtgacctccaccgccatacagatggtgttcggcgacaccgtcgtcgccgccatcatggaggctcgccgcctctccagggaccagtacgcctccaaccaccccgccggcaagattggcaaatccctcatcttcaaggtaaacctaattgcaaagctacattgccgtcatttcttgcattagcaaattgattattactacaaatttagtacattagttagatctcaaaacttactgatactaagatcttttactttatgagttgcttgtcggtgcgatcagttatgcgatttttccagggtggaatgttgaactcataataaaggcagaacgtgctggttatgacagcatttctgtcactatccaaacaacattttatttctttttgtagttactcgtcagagtctttttcattaggacactcaggttgcaatgaataggagtccttattcacaggtcattttcacagtatttgcagccatggcagaagatgctggatgacacctttttttttgggcatgattcttgatggttagcttgtggaagttatggttgctattttttctcatgagtgctaattaccagtaaatttgagtcattttatccttgaattattgtaagaaaatgatcaattatttccttgtatagatctttggaatgtttttgtcctaggagcctatttgggtatggcacatttggatccaattccacaggatttaatttaaatttgaactgaaacccaaagattccaaacaccctagtcaaatcatgacaaaatttcactatgcaggttaaggatgttatgaagaagcaaaatgagcttccattgtgcaaggagggagatatgatcatggatcaactcactgaactcactagtaaaggctgtgggtgtctacttgtggttgatgatgagtaccatttgatcggaactttcactgatggtgatctccggcgtacactcaaggcaagtgggcaagcaattttcaatctgacagttggagagatgtgcaacaggtttgtctatgctcagtctttatgatttattagtcctttatggtaaaaataaggttttagataactcgtacagaaccaaaagcaccatacaactggttttcctactatctattcttagttttagttttgttttcttaaattattgtgcttctctaatcttcaaagtcattttaagtgctctttttggaggcaataacctgaaaaatggcaagctgagccatagcgtccatggttgggcgcctgggccataaggaacttaaaaaattatatcaagtgctagaacgcacataaaagatcatgataagggactcctcttttctttcccttatcttttaacatgtggttttcctgaaaataacacagatcaatttactgaaagttatctttgtattattaagctacaaaggtggtgacatttctccaaagagttgtggttcttaaaaaatatacccaaactgtgctctcttggcaacattcatttatagttccagcaggtctatagaaatgttagcatccaagaattaagataagttttcagcgagagttggttagtgagtgattttttgacagttaatttcctttttcagggctagttttggtttttttgctctcctattcactgatcacatccttgtgttttgcacaatttcatctaattttatcgtcggtgccccctaaaagaattccgctctgatgttatatggttcacaagatctgttgggctgctcaataatgtatttcctgatactgcggcgtgttgttataagatctggtgacagaattttgtcagttctctgtttgcccaataaagggctacagctatcaactaattatgtcaagaaacttttattgagatgacagttcagtctatagagctgtgctggtacaactcttgttgtagaagcattggccaactgatgtatttaggagagtagttgtcaacttgggaccaatggtaaatttcatttttgagtgattgaaggcaagcaaaggtcagttgagtctacgtcgagttgagagcactgttgtctgttgattctaacgtcggtgatagaggcaaatgctacgtgtagaattcagaatcgtttggaagtaatcgttcttacaaatctttctggaatcagttttgaccatgatatatagccttcctcttaagtctaaacatgtttgttgatctttcaggcacccaagaacaatcaccgctgatgcaatggcagtacaggccatggagaagatggaatcgcccccttctccggtgcagttcttgccagttgttgatagcaacaacgttgtctgtgggatcatcacattgcacggattggtctcagctggactataatcttttcgcctcatctccttgcgattctttgcaagtatttggtccagtacatcatcacgctggttgcatggattcttgtcaaatggtgacgccttatctttgtactagtacgtgtagcctagagtgttaaagaggcattgtttaccagtgtctcctacgtctagtgttctaaaagagcaatgtgacagttgctcgctggatgaatgtacccttccctctgtaaatgaatgtgagtttaagatgcagtggaataaaaagtttaagcctaaacaagcagacatgttatttggtttagctttttaaagccataaaccactcctacactgttaagccaaaaactacgtttgagtagttttgcaagactccaccattttgcaaataacataagtcacattcaaaaggaaatgaatgtgagtttaagatgcagtggaataaaaagtttgagccttaacaaacagatatgttttttgtttagctttttaaagccataaccactcaactacgtttgagtagttttgtaagactccaccattttgcaaataacataagtcacacattcaaaaggcacaaggtgtcaaacgcaatgcatagctaactggagtagaattttgcaactagtaggcctggtgaagttcaaacatgcattgaacaaacacaacccttcatggtgtgctcaatctgtgacattcgatctttagctccatgaatctaatagatatctcctaattcgatttcgtggagaaagtgcaacagcatccaaattttggtagcgatgatgttcaaatccctccatgctgctggtgcctacaagggagcttcacctttcccactctgaatctgggtgtgggcgctccaccctgggcttgctagctggtgatggacttggctggtgattagtcaaggcctggtcccagcccaagatgtgcggcaatgcgaactgcacatacacacactaatcaaccacaaaaacacatggaagaagccctaagcagaatctttttaagataatggattcaaaacctggcagctacaattacatacctaaccaaatataattacaaggaagaaatatgttatatgtatatagcagcctcaagtggcttgtcgtggcaatgagtgctgccaatgtcattactatgatatgataaatgaacaatgccaccgagtagtgtgtcattgccaatgaagcggtagcatagagctgcttaacataatgcatgcatgattccgctaatgagtaaggactaaaccatctggtaatgttgatacagtaaaattagaatatacataacacattcacaatgacattaatactgaagcaacaacagaggcaatagacataaggtttttattaacttgtttaaatgaagctctgatgtatgccacgaaactggtactatacactggcatgaactgtttcaatataaagctatgataaaaacagtagtgcacctaatttattgatgtctttaagcttagctacatattgactaactggacaaaattatagtttagcaacagatttcaaatggcaatttggaaacttacactcaatgctgtgcgcataactgtaaactcagcttttgagattgggagtgaaagtcgctcagttgtcttctgcaagttgttcagaacagctgcaaagaagattctgtgatgtatctgtcactgaaaccatggtgtacaagttgataactggctattaagcaggaataacttcttgtactcttttcatttcaggcagtcattttaagagttcgcaatgaaaaccaagtcaatagtcaagacaggcataactttaaccacataaactgcagtgttggttattatacaagttttaatcactcagtcaactttagatcctgttaggtattatagctgagggttgccacaggcacatgccatagcttaatattccgccatgctaaatgtcaactaatcacagacataaaattcttatgaaagagaactagtataacgactccatggtcaatagttgttcatgatgaaagtgtttgtggtagccactagccagaatgcctgcaacactggatagtggatacaccctttagcacacaatataattataatgtaattacacaggcattccaaaaatgctaacagaacatctcaagatgtcaaccgattgatcaaatcatcaaatgatatttgaccaatttgaccaatggcaatgtcacaaatgaacataagaaacaggggtatactggtaataaaataaagcatgtttgatacgttactaaagccacttacttatattcagaaagtatccactgtcattgccgagaggagtgactgacaacgattttttcacttggccttcatgactgacaaaagtgaagagggtaaggttagaaggccatgacttcaaagcataaagcatctacaaacagtacgtttgttacaaagttataaacaaaccttgatttcatggagggatcatggaaaaattcacaagattcagcaggcccaagacttatcaagcttccgacttcagtaggtgacagagcaaagagctgtagaatagatgtcgcagataaacaaagttaatagaacttagttttagagagaaacaaagagcaatctggtcactactcctgtatggagcgtaaaaacccacaaagtgtagagcagaagtgacaaaactcaaaaaaagaaaaaaaaaatcaagcagtctttattaccagatatgatcctatgatcatcactacaaaaaggctccctccctctcatgactaaagtgagattgagcacatacagttaaatcatgtgtaccaattaacttggtagctggtgcattatttgtagcaagcatcatgcaaactcatttatattgcattagatgcttataaaattgcatattttcttgagtgaaccaacatataaagtattggcaatagccaataggctatggatctacgctgctttggttttcataaataaatttcttccatatgaatttgacattatttcatcccaatatggatacaatgttgatgtgactagcgattatcagtgggtaggcatattttattgccaggaaatatcaagtactcaagaaatatcattacctgtttctttgaataatcatatttcctttgtcccacagccgggaaaaaagtcaacatcaccgatccatttttgttcacacgagatcctccagactgatgaaataggaaaattagatagtgcaaatttggaattgtatgttagaacacaaacaaataaaaatgtgcatacttccagtttgctgaagcttggcagtatgggttgcatagaaagtgcagcctttcccttgaacacggtgtagcttgcaaattttctaccagatgtgttctctgcataaagatagtaaacaatatgtttattagtatgtacacttttgataaaattagcaactttgactaaagtgtataaaggaaaaagtcttcaccgtctgctgcaaatgttgaaagagcatgttggaaagtcaaagaaccactccagagagcatcctttaggtcagtgactctcctgagaagggggaatacacttattggagcaggtggaaagaacagaaccataacacaacaaaggattgacttgaagataccattgtaagattggttggccgtactacttaaattgccattcactatatacattaattactacgcgagaaaaaatgaactacagaaaacaaattaaccaactaaaccagcatgaacttgatcagctccaaacaggatgctaagttgcagcacagccttgaattttccaattgcatgtccagcagcactgcattcgatcgttactaaactttactgtaagaatctcgcaaatagtattgttacgtcaacacaacaggttcgatttgtgtctgggaacaagagatcagtattattcacgcacaacttgtaacaacaaaataagtaaataacaatcagctcagcaccaccgaccgattcatcactacccaaacacgggtcccgtgggtcaaacggggatacaagtgactgggaaagtacaccgctgacactctgcgcaactggagcaaaaccataatataatctcctaaaacatctacaacgtaattaacacataaaaacccatggcgaagtaaaacgggggaggaaaaaaaaacacacaggccctaaccctatcgccaaacccccaaaaccccaccccgtttcaccgtcgattgcacaaggcacaccgaactaggagagagagaccaccaaacacgaaccctaagatcaacgaaccggtcggcaccacgagtcccagacgaggccgcccctccacaatcgcacaaacggatgcaccaatgtcgccgccgccgcggctagggcggccgagagagcgagcgcgcgagcgctagggtttaagctagggtttagggtttaggcggagactgacctggaggaggaggggacgaagcgggagaggcgctgcatcgttggccttggctttccgccgccgtcgcgttgcccaccgagaagcggatgccgaatggaatgggagaagaggaaaaaagcagcagggaacgcgccgcttgtctcgggaagccagccgcatcggtggcggcgcttgcgggcctggcaggtgggccagcccacggcccaatccggcctccccggcccaacagccattaacgagtgggccatgtctcacaactcactattactccctctaccaaaatataagttttttttattgatatagtattcgagatactattttgaccaataatatcagatgttttaaataaaaagagttgcatattactccatccatcctaaaatatttgacgtcgttgacttttttaatcatgtttgaccgttcgttttattcaaaaaatttaaatattttttaattcttttcctatcatttgattcattgttaaatatacttttatgtatacatatagttttatatatttcataaaaaattttgaataagacgaacggtcaaacatgtttaaaaaagtcaacggcgtcaaacattttgggacggagggagtatgatagtttgtttaataataaatctagtaacattaattttacatgattaatcttttttattattttactgttaatggtcaatgttaaaaatatttgacttgtcactatgctaaaaatgtgtatatttttgtacggaggtaatactatttttttaaaaaaaaaactttagcgatgatgatgacagatatcaagtttttggagaacaatgtggtatgtgaagttgaaaactttgaagtagtttgcatatattgatagttacctcaagagttttatttgcaagaatttttcagtttcgcggggaaaaagtttttaaaagtcgggttcagttcttgaatatgaactggaaaatgcatgtttgtccacttgtccttgctgctgtatggcagctaattccggtttatgtttgctctaatttacaaattacattcatctctcgagaccgatttcgtgctcaatttcgcgtgcatgaataagatataattcatggaggcgacgatcaaatacacagcaagaagtcgagaagagatcggggaaaaaaagacggcggattcgtggctatggctagtagtgaattgatcactaagcttagttggccttcttggtggtggcgccggcggcgccgccgcagaaggcgtcccggttggcggcggcgccgccgcggacgaggaagtggccgagcgacggcgtggcggtggcctccacgcggttctccgggcacaggaactccctcgcgcacgcgatctccacctcccgctggtagtcgtgcaccagcacctccgtctccgaccccttggtcctcgccatcaccgccgccgagaagatcgccgacatcctccccggcgacccctccgtgaacctacacacatccaacatgacatcatcagtgttaaaatataaagtgaaattgttcgtccttgctcaccagcttaagttcctaagagcaagtttaatagtacatcccactactagcttcaattcatctatagccaattcatacaataattgcttattatactgttagtatatggtcccacctatcatacacacattgcgtcttggagtctgtgctgcagctggctacatatctatagcccgctgctcttctctctcatcttttatctcattaaaatatgtttgtagctggctaatagcctgctattgtgcatgctctaactaaacagatcagtacatatcagaaccagatatctcgtaatcgaatcctagttagcgcacgctagaggcttaagggagagggttggaatataaaataaaaaaatgctatcgataaatgttcaatttcaaaaaatatcatcatacaagccatcatacgagggacttttttttttcagaaatatcatcttaattagggttttgttagcagtcttccgttaagatggatgatatttcttggatatgagtgtttttcaatgatattttttagattttctgtaaaataaattgtttgtcttttctcatcggcttatggttaaaatgatcggtgcatacaactcaataagcaacattatcttttttttaaaaaaaagcagcagcatccatggccgcacattatgcaaggcgagatggacacggaggtagtaggtgtttgtttgctcttacccgcttgggccatcgacgaggatgacgtcccaggagacgtcgtagagctggttggggaggtcgttgatggcgaggcggcagtcggagaagaggaggttctggacggggcggcagtcggcggactgggcggcgcgggcggcgtcgaggaggtcggggaactcgcggacggcggtggcgtacgagacgtcgtacgcctccaggcccgggagcgcgccctccacgtgcgccacgtagaacgggttctcgtccaggaacaccgtccgcccgccgtggttcagcgcgcgccacagcggcgtctcggcgccgaggccgaacaccagcagcctgcacggcgcgcgccgccggagcaccgacgcgatcgcccgcacgtcctcctccggcatgctcgccgtcgcgttcgcccccgccgccgccgcgtactgcaccagcgcgtcgaacacgtacgccggcagcccgcccgctgctcccaccgccgccgacgccgcggcggcgcccgccgcgcccgcgacggtgagcctcgcgcgctgcggcagcgctgcgccttccgacgcggcgcgcgccgtggagaagacggtgagcagggacacgcaggtgagcagcgcgaggaggagcgcgacgagccaggcgcagcaacgccgccgcgagccgaggaacaacggcatggacgccgccgacggccccggcgacgccgcgccggacagcgacaccacgccgttgtaccccttcgacgccgggtgcacgacgagcagcttcggcccggacatccccttcatctccttcctcctctcgccgccgccgccaccgccgcaattcttggctcctcttcttcttcctccttgcctcactgacacacaaactgtctgagcttgtgttcttgagtgagtacttggagtgaaggatagttgcatataattatctggagcttgtgttcttttgtgtttagtagatgaggtgatgaggaaggaagaatggttcaccagacctgactgacatttcaggttggaagaaagatggaggttgggatggatgggatatagaggcaacaaagcctagatagcttaattaagcaaagtaaaataagctttgtgatggattagtagtagttggcaatgtttggcaagaaagcaagctagttaaaaaggaattcctgcaagtttgcttcaaagtggatcaaacaattttcttgggttttaatggcactcctgtgatttggacacaggagctttctttctcagaagaagactaatagcaaagtccataagatatcacattggcctctaaattagctattcaactgaactgaactagagtgtgttaaagagaacatatttgcctctaaattatcaatccataaagcttcatcaggaaagaagtgaggacccatgagttttcagtatgaagcacacaatgccaatattccaatcagccgatgatgggaaacatcattaattgattgagaagctgcagaagatggctccatatttttgaaggaaatcagctatcagacatcgaacacaaaaagtcgcaaaaagaccaatatcatgtttggtgagaaaacacattgttgaagaaaagaagactgaacaccctctgacaagggtcctcagctgggaagatgctatcagtgaacacttggaatataagccacagctgtggcaggaactaaagtttgtggatgggaggtgcctgtccatgagccatcttatttttttgttgccttcaagtgaagcctcggcaagaaaccaaaaagaaataaagaaaatggcatggaacacaataagcacactgagaatcatctgcagccctgaaatgcctcaagcttattggagccaatttcaagatattactagcagttgtttaatgcggtaacaaccacatgtgaaaaaaaatggcatgatcattggctctcttaaacaaaggatttagttggcaaagagtaaacataaagtgaagcttaacatttagggcatggtagcaggtatgatagcagagttttacctatggagtcttggtatataagaaggaaccttacctgcttatggatacttcactacgaacaatggctggaaaacttagccgaaaaggggcacagcatcatttgcttactccagtacccgttttctcccttgtctaagtcgactgaatgagaatctgataaacatgagaagcagacaacaatggcaaacaggcaaacatatagagatttttttccacttcaccagcaaaaaagtacaggatgaacagattacagggatatggcaagctttatccacacaatgtccaacattggcaatgctcttgcctcggtgtaacagaagatcaaaatctcacgggtaccatgatcattgactggggtggccacaggtataattatgggcatcgccaggatcatgcagtcccgcaccagtaggccaggtgctcatctttgcgcgaggtgctaaacagcccaccacatttcaagcaaatgaagctgctgccgtcagcaaaagcatctaaaattatctgcttccttccactctcagcaagtatgcagacttcatcagaatccagcatcatgacagggtcagagccaggtacttgttgaggattagtgtttgttgactgcgactctgctatagcacattgtgcaagcaaagaagcgagatcatcaacactagggctgggctgtgatctttgcctgtagagttcccgtgcacggttcagcgtctgcatgagagcctgttcaccaccttgggatcttatggccaagagaatctgcatgattttggaagttgaaaatcaatagaaggagattaattgagttaacagaattagaaaaggtttgatacgcaggctaaaatttatgacctcgtttctacagagaagttaggctcagacagttttagctgtcatcatgaaatgtttcagcgaatgtggaaaagagatcaggaatgtactgactcagtaattaacaagtatcagcacacatatcaacggacaggacaatgaaattgaaacggaagtacctaaaaataatcaaaactgcaacagagcattgaaaaattaaaccgatttattgattagcttactatttctgttatcttaaattcaattcatcagcaaaagtgaacattgtgagacgtatgcatcaataccagtcatgtaatctagtcaccttcttctcattcatgtcttacgtcatagcaagtatgttatacatctcaagaaggtttaaatggccatctgtgactagcagagtaatcattactcaatgtatatgcatatgagttaggaaactaaaatattcagtgtagaacctaatacatcggataaaaaggctaagatgcatcaagaggctattcttgaatttagatcatgctccagatcatgatatgcaatctgcttatgtaatatgcggtctcatggaagctcaatagttcaaacaacagggatataagtgataaactacaaactagcaaaggttatcaggtgaggtgaggaataatcccattattacaataaaaaaggcttggctgatcaaggtgaagctgtaaatctactggtgttctttttttagataatgggtaacctggcctctacatccaacgcggatgtatgcagccaatctactggtgttcttactcagacaataccaatatgtagcagactagcacccttttcatagacattcccattctcgccttaatcagatggagaaactttttagttgttctactttaggtctttagcatacaataaagagagaaaataacaaaatcatgtaacaattgggcaaaattagaaaaggagggacaaactcttaaatttagggagaaacatcggaaaaggaaatcctgcagtaaagaaaacaatcaatgtctcgaatactacaaaaattgtggtgcagttatacgggaactcaagcttgaataattgatttctcaagaatttttgtgcatttgcgcgggaaactctggccagtaggcccaacttaacattatggcacttggaaggattaagatttgcatgaacacactaaatcggttcaacttccccgcctttccatgaccgaaatatgagaactcatttgtaaatactaaattgaattactgatggtggaatcaatacaatacaacactatgagcaccaggtatactgaaacatgcatttcgctgtgaatgcatcactttgcaatcttcttctctctatttcttaagaaagatgagcataacaatacttaattctactatttgctagtctaagaaaggacataaccgaaagggataagtgcaaaagtgagaaggcagacgagcacctaacatcttctagggcggatcatacctaacagatcccaaaccccgtaccctaaataaaccctagacctagaacgaatcacaccaaaccccttttctctgtgcgcataacatcccgatttccaagctggattacgccataacgaagaccgtcataagctaaatcgaatcacatagaacaccatgaacctctaatcgaatgatgaacctctcatcccctaggtaaatccgtgacgcaaacctcgagaattccccattccagcaccgaccgagggatcgacgcgggcacagcacgcgaaatggaagcgggccgagagagagatgaagagagagagagagagagagagagagagagcctcaccgcctgcagcgcgagcgacggcttgccctcctcgagcaggactcgggcgcgggacagcatgctccacccatcccctctcgccgccgccgccgccgcagcagccggcggcggagcctgctcggccatcggctccccctccgcggcctccatctcgacgtcgtacgggtccatctcccacgcctcgatctcgcgccctctctgcctcactcactcccgatcgacgggtcgccgccggtaggcgggtgcacggcggcggcggcgggatgcggctccggatgattccaggagttcgtgagtgctggggcggctgctttattggagaagaggcgaactgaaacggaaactgctgccagccgtccctctcttttctcttgtggctgctatgatgatgcgggtttccaccctttttcgtgcgatgttgggagttcgaaatttcagataggcgaatttattgaattttcgaagcatgaaattgactcaaataagttcatccttttgaaaatatggagcagttatgaatatgacttatcacgatgacgggcatgactatcttatgactataaatcacactgacttgttgattgattgtatgtcattacacctatgggttaaatgaggactcacaaaattaaactatatcaaaaacacaatatcctcgacaagtttatgctttatacacacttatacaaataggatgaagatattgtttcattccgtgtctaagtgtgaagccttgtcattactcataaattatatttattggtccctttacatcatataattgtcacatttatccttttcgtaaaaggtatacccacgcactaagagccagcggcgaaacacaacgtgtgtgtgagggggaggggagggggacagggaagggagggcttgagcttccctaccctgctgaatcaccatcgagagaaagatgagaggggagtggaattattagggtgaggcagaggagtacaggagctggagaaggaagaaggaaatgaactccctccattcactttatatatctatctctgctagcggatatttcatgtgaaggctagggaacacttaggccaccgtgcaaatggcctcaagtatgtgaagacacacgcaagaccacacaccttgtatggataaaatcaccataccacattgtatcgctgtatcgttggtagacggtgctaggtggagcaactatcccttgtcaagggccacgggacctcgcggaagagcgacattcaacaacacggtgcaagcaaaccatacgacacgtttggcactttatgactatccttatagagatgtcaagctatgcgatatatggatcttgtcattcacctaagcatctcatatgtttttcttggttaatgttgtatatttttggagcttctgtatgataactagtgacaaattaatgtatacacaaaatttaaatcctccataatttttaattttttgaatgacgacatgatcttcaaaacatatccttcactacggttttaattataatatataaaaagtaattattttaaatttctaaagtacttttaaaaaccaatctatactctgtgctcaactgtcttaaattaaatattgtaaaaattattgatactaaaaaattatattgtttgaatttgattttgttaaaaacatcagatataatggaactggagggagtatgcaagaggtttatattacatttcataccattctaaacacaatagcaagtactagtaaccatgttcgatatctgcggagataatttactcaaaattctcgctgctcaaattaacaactcaagtttcgaaggaagaaaaagaaaaacatatgctctcgtccttgggccttggctgccacttgtgctacgaacagagtcacaaagtccgtccgcggcaagcgtcactactcttatgtacccacagggacggcggcagcatcaccggcgaacaaacagctcaccccgccacggcccacgccggcgccagcgccgccaccgtcatcgaggagcgccgcgctagacctcgtcggcgggcgctgggcgatgtatccggattccggcgatcgagcttggcgctgatggcatccatggcgccgtccatcgccgccgatcccctctctcgccggcgacacctccctgctaatcgcgacatggaaacccaacttggagcaaataatctgaccccacatgtcagtgtaactaacaggccaagttcatgggccgctcggtcacatgggccactctactacgtgggctctacgaagtatttaggcccaagcggtgggaagtagcagcgcaggttgccgccgcttggttttgctgggagagtttagtaccacctcgcccgttcagctagttgaggcggtcgcggaagctataaaacgaggcggagggctccgtcccaaagcatacctttctcggccttttggctaagatcaagtgtagtatctgttcttatcagtttaatatctgatatgtgggccatgtgcccacttcgatattaaatttattttttgtgggggagggcccactacagtggcttgccactggggtcctcgcgtgtcgcccaggcgttgcactacagcctgggcctggcgcaccccaaccaaatcaaatttagaattttaatcctgtaattgaaaatttggtaaaatactccgtaatgactctaatccaaaattaaagccgttcaagtttatcggaatgcccgaaccaaatcaaatttaaaattttaatcatgtaattgaaaatttggtaaaatactccgtaatgactctaatccataattaaaaccgttcaagtttctcggaatgcccaaacctgatcatctagggcttggcatcactgtgcttttatcagaaaacttgcagccagtatatagtacgacgtgaaaaataattctattcccttgtttattttccttctatttatttttaattaattattacatcggagtgaagttctgtatttttaaaagtaaaaaataattacatcagtaatagataaagtgaaaaaaaattgttttcaagttctgtatttttaaaagtaaaaaaaaattacattagtaatagataaagtgaaaaataaattattttgataaggaggaagtagaaatgaagatgttaatgaccaaccattcttcaacccaaatatacattatttaatatttacaagagatgctaaaattatttatatattttaaaatggagggaacacaatattacaacggaattatggcggcacttaaatcttctgtgtgtcaattactaaaaaaagtatgttcaaattaatattaactcaaatttcaaggaattcaaacaaaatggagacaaaatgctgtcgtattccgaagttcatgttcccttgggccgtggcccgtggccgccacccgagagcatcacactgaacaagtaccactcccactgccggcgctgcccccaccggcggcggcagcggcggcggcggaggccatggctgagctgcggcattcgacggtggcggcggccgcggcccgctcctccaactcccccgcgaagcgcgactccgacgcctctgccgcctcctcccccttcgcctccacctcatccgcgcgcggccgcggcggcggcgacgacgacgacggcaaggatgcgcaccgctcctcccctctcctccctcatcaccacaagcgcctcggcttgccctctcccctccgctcgctcctcgccctcgaggaccccaggtccccctccgcgtcctcctcctaccggatcttgttcgccctcctcgcgttcctcctcctcgccgccaccttctccgcgacctccgtttggtcccgcctcgtgagttcctctcctcttccgaatttcggttttcatcagactcgcaacttaccaatgcttcctgtttttgatcctagaatgcgccctacttgtgccagaaggatgggatcacgctgcactgccctgaggtggagtgttcttcatctgcacacgcaaagtttcagtgaatgttggtgtgcgtcgggagatttggtctaaataatttgtttgttttgggtgcagacgaaggaagccccctccctatgggagaatccacgtgctgctaccacgtcctggaaaccctgtgcagagcgccgcagcaatgaaccatcaggcaagtccagcactcgcatcgcgataggcgacaatgcagcatcttcacatagtttaaaggagttgtaatcttcatatcaatcagtcatttatccaaaattctttgggccctgagtgaactagatggtactccgtacataatttgtcaaaccagctaaaatctgaatttccagttttattttgagattaggttgaactgtgatccgtaatttgatgctaggtcgctggtttatgagacatgatccatagttccatttcagatgattggttatgaaacggcatatggtgattttaatccgtgttaactgttacaaaaaatttcagacagaagttaggtcgagatccattgtttcatataatgtggttgatttataagaaaacatatggcatatttattccatgctaattattgagacattgcatatgagatgtgagggtaaatttaaaatgcagttcgcatccacctttttcgttgttagtgagcaatatgagtacatgggtcaaaattcataaataggatactttccttgtaaagtactttgctaggtctagttaactctatttaaacgtaagctggtctttcttcttgccatgtttcttatactgtctcttaatgattcattgcaagcaagctttcttcaaactgtgtatacacacacacttttgttttgtacaattgtgccttcaacaatcattgaacatcagtttcttgtcatgagtgactataatatatgtctatatcacgcagatgtcccacctgagaatgaaacctctggatatatttttattcatgctgagggtggactgaaccaacagcgtatagctgtatgtatgctcttctatttctcccaggcttcctctccttattttgtctcagtggttgagtgctaaatgttcgtttagatcctgcaacggtttgctgcctaagcatatatttatcacaatataataatgtataccagatctcgttatttgagaactatttatcttatgagattagttgttgcaaaaggacaattacagtagcctttcagtataatctataattcctcttgatagcatggttgcatgagtttattatgatctactaaaagctggattaagaaaaatatatgttatcttgctgtttaatactatttaatttcccctagcccacagaatgatcatacagacttcttgagcagcagtcattcgtgtcctaggatggcattgagttccagttaaagcagatggtctgcatgttaatttcactcatctcttgttttttcagatatgtaacgctgttgcaattgctaagataatgaaggcaacgcttattttgccagttctaaagcaggatcaaatatggaaagaccagacgtaagttttcaagtctagtgtcttctacttgtctgtttcccttatgatagttagtgggtagttatatgttacaaaatttgcttcgctaaatctctaatgaagtgccctgcaactcaggagtcaacacactgtccacttagaatgtgagagtttagaaatgcagaaaaaattgtgttctgccttgatttcttatttattctcataaatctaaacagttgtcttaatctttctaatgttgatgcatttatgttgaacagttcagcagctgctgtggaaaataaaattgactaacttttctgcataagtgcgcttcaaatgtagttgtttctgatacttaaaatgagcattgtagtgttgcaccctcagttattttccctgaaaaattcatgaccactgtaatgtttctgatagtatgcttacaatgaccattgtagtgttgcaccctcagtcattctccctggaaaactcataacgactgtaatataaattaatttctggctagtaaattagataaggaaacatttttattttgtgttgtcaattttaccaagctagtacatggacattaagaatccaaatcaaggttgtttttagaacatttcaatttatagtaataatcttataaccgcagaagtttgtgatacgtgcttagctggtgttaagttcaattccataatgggtactgagtcccatacctggaataattgctagttgcatagagtcatgaactcatgattttcttagttgcagtattttctgattcgtttcctttatatgcattgtgttttggcatcagtaatttttaagcacatgtatcttatgtgcaggaagtttgaagatatctttgacgtggatcattttataaactatttgaaggatgatgtgcgcattgtccgagacattcctgactggtttacagaaaaagatgagctctttactagtataaagtatgtgctacactcacacttactccttgcatttactctgaactacctttacttttggaaaatcaatgttacaacaagtgaatactgttgacaatgagcttggcaaaaccatttgctattttgctgccatcatagcattttttcatggatttggtgaaaaacctaatactacttccatgctgttatactgtaattgtcttgtatccttagctagagtcatttaagaatacatttattttatttttaaagattttattgtatactcattggaagtccagaggaccatctgaaatatatccatcaaaacagttgtttccaagatttctatcagttttcttggttgtctttgttctatctcaagatgatgggagagtacactttcatataaccgttatagaattgatattgtcatcccaaagtccaatttaaatccccactgcctacagtttagtggaaccaagtatcctgtgactatcttcttaccacgaagtgaagatctatgattaaaacgtggattatttctttttgtgagcaaaaatggttggaactgttcaaagtctttctttcactagctgctgtcctgccttgttctccctattagaatttattcgtttaccttcttaatttctcattcattgtatgcattgatcttcttgtacagtgatatatatgttagagatcaacagattgcactgtattcataccttttatttatatatatttcactgtatttcattgatctatcacaggcgtactgtgaagaacatcccaaagtatgcatctgctcagttttacattgataatgtactcccgaggatcaaagagaaaaagataatgtctattaagccatttgtcgacaggttggggtaagtcaataattgactgatgattattcatacattttattccgaaatccaaaatatcaatcaagttcaatcagctccagcacattatgaagggaacattgttccctcctttttttgctttgtagtttctgatatactacaatttaccatatctttgcatggcattgaacaaccaaagcctaacataaaaacttcaatttcaggtacgataatgtcccaatggagattaaccggctacgatgcagagttaattatcatgcactaaagttcctgcctgacattgaagaaatggctgataagctggcagcaaggatgaggaaccgaactggcagtgtaaatccgtacatgtaagctaccttagagaatacagccatctgctgcttgcccaacctaactgaagttggcaacttaagttcatttctaatcaagtgtagcactttccttttgaagggctcttcatctgagatttgagaaaggaatggtaggcctgtccttttgtgattttgctgggacgcgggaggagaaagagatgatggctgcttataggcagaaagaatggccaaggcgctataaggtcatacagagtcccagttgtctgatgagttcagtctttaaactttgtagatgtgaagcacacatgctttagcaatctaacaaattgtctctttcctgtattcccatgcagaatgggtctcacctgtggccattagctctgcaaaagagaaaagaaggccgttgccctcttgagcctggcgagatcgctatcatcctccgggcactgggttacacaagaggaacacagatatacgttgcgtcagggcaagtgtatggcggcaaaaacaggatggctcccctccgaaacatgttcccaaatttggtaagcactagacattcgcactccccttcattaaaaaaaaacaaaatactatcatggccttcatgctcctgactagtgtagcagtagtgatcactgaacacagagttagaaaagctcattctactaaccctgaaaaacatccatgaacacagagttagaaaaactcattctactgaccctgaaaaacatccatgggcctcattgaggcatgctattttggcctcatgaatgtttctagggcaactacaatgatgccgaaagggttcaatgaggacaaaatgctatcatggccttcgtgttactgactggtgaactctgaacccagaatagtcacaaatgctcattctaccgaccctgaaaaaccccaatttggtgatgtttttgggaaaaaaaaatgattgcagcttttgaagccaatttttttgccctatcaaatttttgacagctttattagtgtcatatgaacattttgtttcttatcaaattgagtattgtagtagaaaaaaatagctcaaaaccaaccaaacaatctctttgtttcgagattgaggccatgactgatcggcttgttggtgcaggtgaccaaggaggagctcgccagcgcggcggagatggcgccgttccggaagcacgtgacgagcctggcggcgctggacttcctggtgtgcctgaggtcggacgcgttcgtcatgacccacggcggcaacttcgccaagctcatcatgggggcccgccgctacgggggccgccaccggctcaagtccatcaagcccgacaagggcctcatgtccaagtccctcggcgacccacacatgggctgggccgccttctccgacgacgtcgtcatcacccaccagaccagggccgggctgcccgagcccactttccccaactacgacctctgggagaatcctctcactccctgcatgtgtcctacagcctgaacccccctgatgaatcttcaggcttgaaagttcaattatacagttaggatcactggcagtatagtgctagaacattttatgttcttgttttttcgttttcgtttttttttttgctcacgtagtcctattactagcaggatttaccacctcgattggtcagcgaaattcgagccccagcgaagcgtactcttttgctaattttgaacaaactttaacatatttcgaatgaattatgacctgagatgaacgttttgagccagctcatggtgatagaagtccgcggattttgcttaaaaaatcgtcgagatcatgaatcaaggtgttttttttttcctgaaaactatgaaagattaggtaaactacggtcagtaagctaagattaagagaatcagttgattgataatcaacttctaagaaaactaaacttttcagtttttatcttttattttatttactagattctatagctaaaaagttcttaaaatctggataattataagaaaaactacgagtgcaacgaggctttacaagcttcccaatcagagtactctactttccttttttgatagaaatacgctcactttattcagataacatggcgatcagtggaatccgatctaccaaaatgttcacaaattctaggaggggagcagaccaaacatttagtaacggataaactggatgaactggtcctggattgggccttcgttggtgaactcgttttattccgcagatgaagatgtggactactcaaaaaaaaaaaaaaaggcaagtctaacgtttgaccgttcgtcttattttaaaaaatattaaaacattaaaaagataagtcacgcataaagtattaatcatgttttatcatctaacaacaatgaaaatattaattataaaaaaatttcatataagacggatagtcaaacgttgtcacggaaattcagggtttgatttttttttttttggacggagggagtaggtagtagatagtggatgattcatcactctttcactttactcgttggttagttaaacaaaagcaaaggaagaagaaaaaaaaaagcactaggcttacgttactacacacgcggcagacaagcagcccatgcatgcttgctgctcgccacgtcctctcaactcgaaagctgtttataatgcaaactcgtagcctctctcgatccccggacacagattcatcaccactagaatcttccacacaaaactcagtacaagatcggcaatggcgcagcagctgaggacaccggcggcggaggaggcgctgctgcgcggccacgccgccggtgacaaggacgacgccgtcgccggcgagagcaaggacgcgaagcgcgcgcgggcggggctctgcggcgtgctccgggagcggaaggtggtggagctggcgcgcgccaagcggcggctggtggaggtcccctacacggcgacgctcgcgcacacggcgaacgcgctcctcgccgcccgcgtctccgctgtcgcagtcgccgcgccgccggggcactggatcggcgccggcgggtccatgatcctcgagtccgacccggccaccggcgccgtccgcaagcactacatcggcatggtcaacatgctcgacatcctcgcccacatcgccgaggccggcgatgacaacgacgccgccgccgatgctgctcccagcgaggccgtcgacctcgaccgccgcatggccgtgccggtctcctccgtcatcggccactccctcgaaggcctcaccctgtggactctccatccaaacaccaggtagtgtcttcttgaattgaaccatacaaatcatttaatttctttcctcgccaaaaagggaagaaaccattatttcttcctgacaaaatcagatcataaataaattgcacatttgcactaatttgatttctcatcatcgtggagttaattagctgttgatgtgtagataattagtgcttattcgggttgtaggatttttttaaggaattttaacctatatatagaaataggaaaaagaatagaagaaatagaaatacatgcacactttaattcataggaatctttcaagaggtttaagtggtagaaaattttgtatgttttctttctacagcttgtaatgaaaaatttccttctgttttcctatactcatattcttgttacaaactgaaaccgaatgacacacataaaaaaatatttcttcagaattcaaaacctttgttttttagctgttgatacgtgtaattgtaaaaaaaaatgtttttattgacacgttgtcggttgttgtgaactactccaatcttgctcacaaaattagacaataaataaatataactaatttcttattctagtatgtgttaaattataattgtaaaattacttgttaatatgtccatttgcaatataagtttgtaacaacattttttttttgaaacaacccgcataagatagtgtgagtttatatagacgtttctattgacagagagaaacaatttcagaatggtgacgcaatttacgattgccttttacaatttgtgttttgtgaactgcaagtgtgctggattgcatggagacgttcagcaagggggtgcaccgcgcgctggtgccgctggagagcgcggcggagaatgtggtggcggcggagctcgtcgaggcggcgccggggtacaggatggtgacgcagatggacgtggcgcgcttcctgcgcgcgcgcgccgccgagctgggggacgccatcctgtcgcgctccgtgcgcggcgtcggcgtcggcggcgccgtgctcgccgtggcgagcggcaccaaggtgatcgaggccgtccgggcgatgcgcgccgcgtcgctcgccgccgtccccgtcgtggacgccgcccccgccgacgacgccgacgcgcggcggatcctcctccagctccaggacgggagggggaagcgcgtcgtcgagacgttctcggcgacggacctccgcgactgccccgtggcggagctccaggcgtggctgggcgtcgccgtggcggagttcaagaagaaggtggccatgtaccgcgccggcgttctcgccgccgacgccgacgaggacgaagagcggcggcgggagatggtgacgtgctcgccggagagcacgctgggggaggcgatcgagaaggcggtggcgcaccacgtgcaccggctgtgggtggtcgacgaggaggggttgctcgccggggtggtgtcgctgaccgacgtgctccgcgtcgtcagggaggccgccatcggcgaggaccgggagctccacgacatcctaagctagacaacttttttttttttttgtcgtaaagacaagaaaagtatgtatctgcactgcaaactgccatggtcggcacaatgtggttgttttcgtgttgtgaattttgctttgtttccatcaacatcaatggatcggtttgggctggtttagttctcaattttttcttcaaactttaaatttttcatcacatcaaaatttttctacacacgtaaattttcaactttcttaactttttcgttacattgttctaatttcaatcgaattttttgttacattgttttaatttcaatcgaacttttaatgtgaactaaacacgccttggtaacacactcaaaaaataattttaactagttcacgcccttggtaacacactcaaaaattgtagtttaatttgaactgcacgtacatttattttggaaccgaaggagtttaatttgaaccacgctattgctgtattgcactgaacttaatttttggattatgcacctacaatctctaagaatctgaatttaaaatgcttctaattcaaaaaactctccaaacagacacaaaagggaaaagtacaccgaaggtccctcaacttgtcatcgagttacaaaatcgtcccctaaccgcaaaaccagatatcggaggttcctcaactaacaaaaccgttcgcttgaggtcctctggtggttttggacccggttttgtctgacgtgacaggtgagtcagcgtgggccccacgtgtcaggctgccacatcatctccctccccctctctcactcttctctctctgccacatctctctctctcactcttctctcctctcactcgctctagggcgggcgcggccgctggggggcgccggtgaggtgggcggtggcggcgacaggggtagggatgagaacggcgggggaaggggaggggagcgagtcaagggtggtggggagacctcgtcggcggcgaggcggcggaggagcacggcgaggagaggagggcgtcggtggcccccacacccgcaaccacccagcacatgccgccgatgcccggtggtccctcgcgtgcctcgacccgccgcggcggaggggcgatggcgaggagaggagggccggcgtcgcgggcgcgtccggcagccagcaggggaggagggccggcgtggcgggcacggtcggcggccgacaggagggagcgcggcggagaggagggccggcgtgacgggcggcggtcggcagccgacgagggaggagcacagctgagaggacgcctctctgctccgcccgcgcccggagccgccgccgacgatgagggcgagtggcgcggccgtcggcgccgctgctccctatccgccgccgccgctccctatcctccgctgcctctcagccaccgcgctcgcccaccgacgctgcttctccgcagccacactcgcccaccgaagccgctgctccgccattgtgctcgcccgccgacaccgccgctccgcttgctctggccgcccttctggtgtggcggcggctccttcggggacgaggccggcaggttcagatcgaacggcagcagcgagcaacgcgagacgggggcctcgtcgtcggcgcccgaggtgctgtcctcgtagagcacggaggaacaggagctgcgacggagagagcaaggaggccgccgtcgtcctccacggcagcaggtggagaggtgacggaggccgtcggagtgggagggcgggcgcaggaggacgaggcggaggcggacggcaccgatagggagcgcgacgggagagcgaggaggccgccgccatggttgcacatctgtcgcccgcgccgtcggcggctgcggtggcggcgtggggggcggccctcctactcccatgtcgtcgctgccgctgcgtcgcccgtcgcccatcgccggccgcccgacctcctcctctcctgcctcgctccgccagccggcttgccgagacagctcgagaacggcgagggcggcgtggagatggggcgggggtcgttggctgcgaccccggcatggcggcctgctcacgcgttgcagctgccgtcgctgcctcgtcggccgccaccctcagccctgtcacgccgctcgtggctgaccccttcaaccggtcgccggcgtcggcatcaacggaggaggaggccgcggccatcgcactcgcgcagagaagagaagagtgagagagagagaggaggaagggagagatgatgtggcagcctgacacatgggacccacgtggggcccacgctgactcacccgccacgtcagacaaaaccgggtccaaaaccaccggaggacctcaagcaaacggttttgttagttgagggacctccaatatctggttttgcggttgggggacgattttgtaactcgatgacaagttgagggaccttcggtgtacttttcccgacacaaaatcaaactcggcgatcgaagtggggcccacgaggtttgccttgggccaaggagagatgagaggttggtcgggttggtcgtcgtcgtctcggtctccggcaaatttgaccgttatttggcccagtccatagaattcttttcccattgttgcccatatttaaaggcccaattcttagcaatccagtctgcgcgggcatcgtcacgatttgccgtgcaactctagctcatactccctccgtcccataggtgacgtttttgactttttatttgtaatgtttgactattcgttttatttaaaatattaatgtaaatataaaaaagataagtcatatgtaaagtacttttgataataaagcaaatgacaaacaaaataaataataattctaaattttttttgaataagacgaatgatcaaacattgacaaataaaaactcaaaaagacaagtaatataggatggaggtagtacatgtcttgggatgttgttcgctcccctgcaggaagtgcgacggagtgacatcgcaagctatccatcgttccatttccatccccttgtgacatcggcaattcgcaacaacaggatacggatgcccctctccagcctgcctcgtcatccgatctaatccaagtactatccaacccgcacgccagagcagagcaaaacgcaaacgcctcctcccaacccaaaagcgaagtggagccccgcccccacatcacatccacctcccgcctgcccgccgcggcgccggagagagaccgccagggacgaagccaggatttaaaattagaggggtgtagaatgaagataaactatgagactgaataattaatattgatagtagaggaggttaaatagtcaccatcaaaaataagcaatgcgtaaactagtactttaagaaaaaaaaattaaattttagctctttaataatatcattggaagtttgaaactagtctttattgctaaattcttttaatgtaaactattaaataatctcataaataagtatcatctattttacttttaaaaagatgagaaatcacaaactaattttgtagatcatgtttattgctaatatttttagacttgctaactaactaaactgataatacttttaagctacataaaataaactaaataaatacttatcttagctaatttaatatagagtaaaagcataggggtgtagtggtggtagtgttttgataggggggtgttggaggcatgtaagtttctttgtcgctgacatatgagttcaacgaatcatatattcacttgttagtgataaaaagcacgatgtttcgtgtaggtagaggatctcaatccgccacggcgcccgtctcccgtcgcctcttcttgtggaccctggcttccttggtctcacccaacttgaccgttgcgtagccgttgtaccttttgtactactgctagtgcgacgtcgttattcttccccaccgggtaccaccacctccaggctccagcttcgcatccacaagaaccacacacacaaacaggtccacaacccacaaacccaactccacctgtgtttggtttcttctttgattcctcactggtttttcccgtgtcccctagtaactcaccactgcaaaagttttggacttgcatgcactttggaatgttccagtagcagtagtaacctatcggtcactgtagtgccaaatgaccggaaattctattctttccttatttggacgtcttctcatttttttacgtatcacttaaaattcataaaatattttaacaatatagatatgatatattactccataacatacaagttaaattccccccaaaaaaaaaacatacaagttaaattcaacatacaaatacaaacaaaaataataagtttaactccgaattgaatgcataattcatatagccaaatttattgttttttttctaattatatttgtcgaatttgaacttatatgtttataaaatgatatatctatattatctattttactgaaaattttgttgtttttttagacattattcacaacacgaaaagacatccactgaaaggacaaaaatccatctccgtatgcctccttgcctttcaccaaatttggcctagcttttgatctcctcttcttcaaatgttacacgctgcacctgcactgaaaagtggtgaccacttttgctagccgaaagaacaatcacaattcatgagctacacgcattgcctctactgtattgtactgtacatatgcagcaagattcatgagatcctgactgcctgccatcctgcctagctgtgttcgtcctcacagaggttagttagccggtcaaggaaaaaaaactcattaatcgccactgctctgtgtcctcctctactctcgatcgatcaccagcttaaccgaaaaaaagtgtaattaatttgcaggactagttgtgtctctctacccaactaatcttgcttgcacagtgtgtacttgtatatatatgctgacttgagtgtcagtgaagccactccatttcacacatcttaattagatacagatacaagttcagctgcttatgttagctacgagtagctttcatatttgcattttggggtctactttggagtagactattgtctctggcaatatatgaaactttgtactagttccatttcaaattggtatgtgtttgattaaggttagatatgggtttgtttccttatcaaaatttagtttttttattttctttgccttacaattttacaaactattttagagttttacacttggtcagaaatcagaatacagtgtatatagttttatacagcttaacaaaggggggggggggttgagaattggttaataattgattattccatgagctagataagtggagcagaatgagtcagcattgtgtctggtaaagtggaggagataagagtataatctatatgtcatatactgccactgacagccttattaagactaatcggtgtgattaagattctctacctacatgtacaacatgtgaagcctgaaggtgtccataggagagctggggaggtgcagagttttttgttgacatttatttttaatctgtgggtggggcccaatctggtgagtgcactgattatctcttatggagtgtacaataagtacattcaatgcactctcttttcgtttattttctgaaaaagaaagaacgaaaggcaaggacacttatcatgtactaagaataagaaaaattaaactctagctaatcttgattatttccatgtactgtagtattgtactgattttttccccatgtactatcatggttgtaatatgtaaaagtattttcaagataattcccttacagtagagttaggattattattatttgtacatttctgccagatttcctaaaaatgtgtgctacatgccatgttaactactccctccacccaattttaaacacacttagtgggttttttattcaatgtttaactgttcgtcttatttaaaaaaattataaaacaaatttaagaaacaagtcacatataaagtattattcatactttatcatcggataacataaaaagttttaaataagacggacggccaaatgttagaaaaaaaatctataactgtatttaaaataagatgaaggagtacaccacaaatggacaataaaagagtataaattcagaagaccagttacctcttccatctaaaaagcagaagtatttttcattttttccatcactaaaaatccaatatttttcccccttttctgcaacaggaggagacacctggccacctggcctctcctcagcaacagctcatattgtttgatttcttccttctccactactacctccacttcctccactcctccaccccacaatctctctctctctctctctctctctctctctctctctcctcccaaattcatctccttttctcatcttttctcatgctttgacgccaccattaagctttggcttttctctgcctcccatctcctcctctgccactagttaaagcagagagagggggagaagaaaggggaggagaaagaagcacgggagagaggaggaggagaaggagaaggacaagggaacgaagatgttcgacagcctgctcaactccaagttctacaacaaatggtaaagaaatgtttcaagctgattagtggttcttgggatttcaggtttagcagttcttgaagttccccttgctgttcttgtggagtccaaaatcgatttcttggagttctttgctgtcgatttgttgtttaactttttcaagctgcgtagtttagtttaaatggtccggattttttgggattaagaaactgcatttgctcgcttgatgggttgttgcatcagggggttggctcttcagttgcttgaattttgaatttgattggttctactccaacccacatctgcatgcctgaggattctttcttggactcttgaactcccctttttcctttggattggattagtttaatttcttgggatttttttcttgttctaatttcttgatttgtaattatttgtgatgcagcaagcacgcaatcaagtgcacccggaccaggctggatctggtgcggcggaagaagcaagcgatggtcaagttcatgaagaaggacgtcgccgacctcatcggcaatcgccttgaatcgcacgcctttggacgggtacagcctgccaaccctaagcctcagcttgcattgattagtgttcttgaagaaagatttactagcttggtgcaaattggatgggcaaagttggagttgtttttcttttcagttgttagcacaacaggtgtcggtgcagttaaaaattggtgctttgtactgaagaatccttgatgagagccccttttagggttgtagaagtatgctgctgatttctgctgtttattttaatgggctgcagatggaggcactgattgttgagatgaaccaagcatcctgctatgatatgatcgagcagtactgcgagtacatagtgaagcagctcaacaacctgcagaaacagaagtatgtttgatgtttattgttatatatcaagacaactgaaacaatactgagagttgagacatggcgttccaagtttatgttaatttctcatcgcagtgtatgatgtcttatattttagttgaccactgccacacacacataattatattttcttgctctgatatatctatgagctgttgaagtttgaacccaagtatgattgcatatagattttctatttaattagctgtgttggttcctggcttatgggaatggttcatttcttgcttttagtgcattggcatagattgattcttttaatcaattattctcatgacatggcaaactccagttgtcatgtatattccacctaaatatagaaaacacaacataagttcagtcaaggggctcaaggctaagcaaacctaatctttgctattgatttatattgtctgcagttgtccgttatgttgttctcctagacttacaggatctggaaactgcagagctgctcatagcttgttgatgattttgatttgtttaagtaccttaatcttaagagatcacaaagtattcgggaaatgggatcggctgtcgttggtttctctttaacaatgtcttgatatgtatatatcaaagtgtcctggcatgccatactacactgaaacaaacttgtttatggtgacagtagcaattgagtaggtgcatgtttacaaagttggatacagctcttgttgcaatcgtttaatatacaacttttgttctgctgcaattgatctttgatcactaactctggtggcccatttacagtgaatgtcctcaggaagccttggaagctgtgtcaactctaatttttgccactgctagatttcctgagttgcctgaactgtgcgacctcagacatatgttcacggagagatacgggagttttgtcgagccttttgttagctctgaggtgcttaaatactgtccttgttgatgtgttttgagttgctcactcgtatcacaccaatgttgattaactcaacctttatgtggccagtttgttcagaagcttcagaacaagtcatttactaatgaagagaagttgcaagtgatgcaaagcatagctgaagaattctcggtcccatttaattccaaggcactggagcgaaagatatctggtgtacctcaaaataaacatgtaaaattttagtgaacttactgaatcacatcattacatgcattccatcctaaatatatgtaggtttacttatatgctgaattgattttttcccccctgcaggatcttcaaaacaagagttcttttaagcgtgtggaagttgaagcatcagcatgcaatgaacttaaggtggataggcatgctgtgcatgaaagaaaatctaaagtgacacctgaagtccatgagaggaagcaggagatgccggtaaagcctaaagatattcatgtcatccctgatgccattggtaaggttggggagaaaagcaggaagaaccgctcagatataccttatgatgtgcctccttcggacttgaagcaaattaatgatcaggagttaaagaaagaccacaaaaaacatagtcaccaccagagggaactgaggaatgcagacaagtcagctcctccatacgcagaacccaaggaagatgttgctgaaaagtctgatgggaaaggctaccatgtccatcgatcgcgcatggctggtggccttgatcacaattggggacatgccgacttggggcttaaaactctgggcctagaaaagcaaggaattgagccagctagttctttggatggtaaaacactgaacaaagctcctccttattctaagccctacaaagcaagtgatgagtatgggcagtctgtgcaagacaggcagaaaatgccagagaaggcagttaacatgcgtccaccttatgtcaaaccaaactctacaaatcaagctgttgatgattacaagcatgccggcactggggaaattggtcaccagagagatggactggctgatgataatacccttcagcccgtttctgtcagaaggaaaagtgcaaagccacctacacatggtgatcgctatgatgatgaggcaaagatgacaagccaaactcctggtggccgacgaaggcattcaagcagaagaaatggttcagatgatgattatgaccagagagttggctatatgctgcccccagatgatgatgctgtcaataatgcgagacactttaagagaatgagtgaacgaagaaaacatggaagcaggcagggtggatcagcaagtggcaatgactacgagtctgatgaggatgagactaacagtgtgattgattttggcaatcttttgccccgagcacctagttctcatcggaaacacaggagtaggagtgctcacccacgcagcggaggccgtgatgatgaggaaagggtgatggataagcttctgatgcactacagcaagaaaggcattgatagggaagagcataaaacaagaacaaaatcaaggacccctcgacctcgagctgatcagcctgctgatggagtcggagaacggtctaacagagaagtggcaccccaacatcctccagaaagaactgtatctctcccttcagactctggcaacctgggtgtgaagcctaaggctcctgctcggtccatttcaatgcagccagacaagtccagggggattgtacaccctagcatgccggatttcgacgaactagctgctcggatcagtgctctgaggaaggaatgactatgagctgccacaaaactgtattcaggcttcagcaggttgtgttctttcatgaacttctctcaaagcaactttcaatgtcagtggtggtcacaggaatcaggggatctctcctggtggtggtaatcttgcttgcagtgctatatgcctagatagaatagtaccaaattaaatggcaatatttaggaataccatacaatattggtttgggtgtggtcctttgttgtgctcatatttgaaagtgaaacaatcttgtatagatgccattgatgaggctataatgataagtgatgattctttctgctagtgctagcatgtgagtttgtatgcatttcaagtttccaaccttttctttttgctggagatgaactgttagatgcagatatggtgtgataaaattgttgtctttgagatctatgctggcacatgagccagagcatttcttggatctttggctttggaacctgaggagttcctgcatctggaggctgtgaccagctgtgatccggaaccttataaatacagtttggctcaactgtctgatgctgatgcatacctgatgttgggctggaaacaaaagaagctgtctcttgcaggattttaatattgatactagtataaagtgccaactgcaaaggatatcaactttgtctgagcactgaaaaatctagaactgagcagattccaatgttttcttcaagcatactaaatcatcagcagtaccatcatgtgacatgatatgatcatacatacgagtatatgaacatgatggtatcctgcacatattgtttgttgaacttgagtcaccaaggaaggccatgtggccgttgctgcactttgacgctgccgacgccgacagctacatatgaccacaactgaacaatgctaattctatatttctatgcacgttcttctggatttccaatcatcagctgccttatttcttttcttccttttttcagagagcttcctattagtcaatcaatactactaaagaaattctttaaacttaatcgaagaaagaaaaaaggcatgggattgatgaaattctgcaccttttttctgttgttaaattctcatttgtttcgcaaaaagaattgcatgaggtaagtggcatgtttacggaaaggtgaaaaacgctcctcaccgattaactaaaaactgactgaaaactacgagacttttgggtcaacgccatacaaaaaccggttaaaaccgatctgttttcacgaaccgacaaccaacggtttttcacgttttgtaaaccaactgtatttctcaggccaagctaagctagaaaaagttcagatgagctcagctcagcccaaggacctcatcacagcgacggcgaaatgcaggatgtagttgtcgccgccgccgccgccgccgtcgagcagctcgtggcagaccagccgttgcagccgggggctcctcggcagcgccccgccgtggtacaggacggtggcggccgccgccgtcgccgccggccggctcgccaggcacgccgccatcctggctaccgctcggaggaacagcggcaggagacccttcacgcatgtaagtatagatttaaaaccaccataaaaactactacttcctccctttcacgggcgtaaaactttctagtgttaaccacattcatttagacgtatatgtttagattcattaacatctatatgtatgtgtgcaatgctagaaaatcttacattatgaaacggaaggagtaccgtctcaggttataggattttctagcattatctatatatgttaataaatctaaaaacaattatagtttatatttattaatatctatatgaatatgaacaatgttagaaagtcttataacttgaaacggagaaaaaacgaagaaagtacacgataaacgcgataaaataagggcaaaactcatagatttaagtgattaactcaccatgaaatacactcgtttgatggatgaaaacgcatgtgagagactaattcgaggtgttttctgaagggtttatatatagatcgatatgtgcatcatcggagacatcgaattggaggattaatcacggaacatcatgaggaggcggcgatgacaacaagaggcgtctaatagctttcatcttcaacattctctcagtttcttcacccggtccaaaaaaaacctgttcttcttgtgatctctgaactctgaaagactcaaactgtaagaaataagtcctgatttacctccctcatctcttcctcatgatcaaatcacctccatcaaccataaaaccaagtataacgcctcccctatcttcaaaaaccggtacaaatagacttcttgggtggtttcgtaagtagtttttttttttctgacgtggacggttgaccatgggtgactcgttgagtcaacaggcaagacccacatctaaggagttgattcgcaccgatttttaaaagataggtatgcattataaccggttttacggttgagagaggcgtttcgataagggtaagagatgagggaagtaaagtagatttattcctaccgataaactaaggccgacaatgacataccggtacggcccagttagctacggcacaccatgaagagctgcaggccataggcccacctgcctgtgacacatccggcccggcccaattacggcctaatccgatacgactacgtatcaactacgcatcctcttcgattattatgcctcgatatccatatatatacctctgctacgtacgccgctgctttaaaactagacggatcgcctttgccgtcaggtcgaagaaacagcgagagatcgatccatccatccatcgagagcttcttgtccatcgccggcgagctctccggtcccggaatcagccgatacctccggagtccggccatgtcgtcgtcggggggattcaagaacggcgggaagcagaagcctctcaaggcgcccaaggccgccaagaaggattacgacgaggtatcacacattcaaatcgtatttttcacatcgctcgattgattgcatcttgaaaatatatttgaatttgagaaactgaaactagcatcaataacattattgatgatcaattatggttgatgaccataatgtgttgtacagaccgatctggaaaacatgaagaagaagaaagaggaggagaaggccctgaaggagctgagggccaaggcggcgcagaagggcgcacttggaggcgccggtctcaagaaaagtggcaaaaaatgagccctggataattaattctttagacgcttattatcttactcactttgtcccaaaaacttaatctgccggatatgtcacatctactaggatgtatattagaatatgtcacatccaatacattgttttttatgggatagcgagagtagttagcagcagcttgaaactgctctagaacagacatgagatgtttcaactcactttttaggttattaatagtagagagtagcagttaattacttacatatatgaggtatcctaggatgttttagaccacaaatatgatggcgtatgatgatttttttttttgcacgacctctctttttaatggttttggactgctctatcagcttatgatggtaatgttttttactgttggtgtggtgatgatatgtttcaccaattcacttcagttccattatcaagttgagtcagtagtcagtttataaacggttcaggaatcatcaggattagaattcagaatataaattaacccaaaccaatccaaactagaaaccccttgtcgtatttttcgaacaggaaaagattatacagtatctgattatcacggccaagatcatttctttttggaacgagatggctcgcaggccgagcaccgaattatggatagttgcacaatgctgcataattaagttttggcaccgtagtatatgaatgttataaagtttttgcctcaaagttcaacacggttcttcaaaatctgatgaggtaaactgcctcaaaaatctgaacatcccaatattgatgaatgaacaaagcagaaacaacgctaccggacgactacaactcaataagcgccatccatttcattgtttgaagttttacatggatacgatcgtggagaaattcagaaagttttcaatcaggactacaactcaataagcgccatccatttcattttttgaagttttacatggatacgatcgtggaaattcagaaagttttcaatcaagatcagctatctttattggggcttttcaacttctgcagtatctgatgtggtagaatgtcaagatctgccagtgcctgcaagtacacagaaacaacttaacaagatactcctatgaatctatgatgtactaaaaatggtatgatgtactaaaaatagtggcaggagcatcaacaaatatgaggctgcctaagttatgaattgtttaatcattgactgtggtacttataataccttaaaagagatgcaatgaccaaactacagatacccccattctttttacacagcagtttgccttttcatggttctccaaaatgttactttgactataactactcgtgacttttgtataatttatattaatgaaatacagtacttatgaacttgacaacaaacctgatctaaataaagtagctctagtatagccaatagattgtatcaaggcatggatgctgaagtgtcagataaaaagaaaaagtgtagggtggtttcctttcatttttgggttgcacataaattttccttgtctaataggtcaacactttagtaatgaaactgtacaagagaaagattaaaaacaacataaatgacaattgagtgatcaacgaaattatcagaaccctccaacacaagtacatcacgattagacaccaaactaaggagaagctgcaattaatttttgaaatggtaaacaagtttaagagaataaaaaagtacaaatattaaaaatgaactgttgaagaaaatgcatttaccattgacatggttaaaaacgtgtagaatcaggcactccatacttgcaccttcccctttgccgtcccaatgtaaatctcattcaactcaggattatatgacaatgcagaaacaataaccttggtattgatgtctgtaatgcattttccactttctatggagcttatatgcaccgctccgatacctgaaagtgaaaatgaatattcttgttaaatcatctgtttgacagtgtagcagatctcagttgatatttatatctttaccttctgacttgcatccagaaataataacatcctcatcttttgttatgaacaacttatcatccacgcaattcagttcatctagtacatgatcctcaaaatttctcactatatctccttgaagatctctcagttctgttgagttattctggaaagacaagaataggtttctaccatgcagtgcatggaactcatatatcccaataggtacctcggtgatctttgaactacgcaactacattaaaatatggaagattgaaaaggatcaggagtgcacaacaaaatgaataacaaagtgattaatactaaatatatcttacatcaagtatctggaggtttccattctcattcgcaaaattctgctttattatcatcttgtcatgtagaggttgaatatcaggtcgtttcgagctagcaacaagcacaaacgagtgtgtttcttcaaagttctgagcacaaaatatcctgaaaggatagacattatgtgtctgctccagctttataaggaacaatgatggcctaagaaaaaaaggagaaagttcaggattaaaaaataaaataaatccacaaatgaacacagtagaagaagtaaacaatggtgtacctaaaaacaacttgatggacattcacatcaggtatttgatacagcagagaataatcctttaagtcaaaaactcggtaggtgctgcagaaaaaaaaacaaatattatgtttgtttggctatcattgcaaggtttatagttacatgataaaaatgatatacctgcgttgttgtatcaatgctcttgcatttggtgcatcaaagtccacactatctggctattttatattttctgattcaaaaatctgctgaccattattctgcttgtttgacctaatgcacctgtgaaatcaaatcaacatcacggtttagaagatatcacagtaagaccacgaatggcaactagtacacagaaactgattccaggttccttactcaagtggggttgatgtgacctgacgagacatgcagccatcaaacaaacgagaagaagttgtaatcacagatttgtcctccttgttgtagaatatagagacaattatttcatcgtcatatctgttgaggattgatatcattttatttgttactgcagcaaaagagagattagtgtttgagcaaatttcatttttcatcgaatttatttacaaaattctaataattacctctgctgagtaaaaagctcaaaccagagcataacactacagcaacaagatcttttaatggaagaatctgcagaactgcagatctcttcctgataggcctctctaagtgtcgaatgacatccttacatctgtagatatcaaatacgacctacaagaaacttaagttaattatactcatctgcagtttattcagctaggaacagcacaacaaaggttaagaaaaaaaggttagaagacaaaacagggaacaactagagataataaccatgaaactctgatcaagcacgaacagactggagggactcaaataaaatttaacttgtatgttgccaaaccacatgttgttttttcagtgaacacaacaccttaaaaataatgcaaatttattcgaattcaaataggtcatagcatactaaagaagtgccttcacgttttgatgacaagctagaagcataataccaatatgggtagagattttctagtcttggagcagaacaatgtttatcgtatgaatgtttgagctacctaagaacaggaggcaagagatcatggattacttctcaaaatcacgtcgactgagcgaaagttctgagtgtataaagtttcgatagaacataagtattgatcacttccactataatcgagaaattagtatatacttgtatgatggttctattctctaagacacatatttacatagcatgcaagaagctttttagataacatgcatgacagattttttttttttaaaaaacgtgaatattagggaatgacctaatatcaaataaatagaaggggtgaggcttcgaacccaggccaactagcccaccaccttgtggagctagccaaaatacccctgggcgtctctcatgcatgacagatttcattgaaagcaagggctccatggaatgaaagaattgcaacataaaacaacaaggactgtagagcaccgtgaatacctgattccgttgaacaatgagaacaaaatatgatatgttgaggaaatacaaaacaggatatataaacatgatatcaggggaaaaaagagtaatgctacacagctacagaacttaccaatttttactacggatttgttcatacaaaatcatgttgcgacatgaattcagtgctagcaattaataatcataagccaacaaagtgaagaacttctctcatcggatgcaactgttttaacaaaacgtaaaaatatcgaggcttagctgatgattgttgtgtcctcaatgcacggacttaattctttgagaagaggcacacggtaaggaagtttagtaccaacttcatcaaaatttctaaggaaacctcaaattattttcactcaaaagagggcacaactcagaataatctagcatagcaatttcatcaagtaaacaaatgaaatgaacagaaaagacatgttagtctgcaagaacttaaaagtcacaataatctaccttattgttctttatcttggagaagacctcatgtgagaatgttgaaggtgtgggtacgaatctgctgatgccgcatgtcctcaaagagcagtgcaatccgatttctctaaattgtagcttcataaccgtgctgcagctcttctttctttgcttgctgctgccttgtccatcctgcgcatgcagaactgcatctttaagcttttcatgttcacacaatgaaagaaggaaaagccacagcttcataagcataggtccatactacgcacctgtttatcgatgcatccatcaattttggccgtcgagacgcccgcagggcctccacgcgcgcaggaaagtatcacggcttcttcatcaactttcatcgcattctcgtcctcgtcttcctcctccaagaaaacccgtcttctcctcttgcctcctcctcctcctctctctaggacctgtcgcccatccgctcttccaccggagccttgatcatcctggctgtcggggatgtcgccgtcggaaatgagactcagtttcatggcttcaggaatcttgttccccccgatcctctcctctgtagggtttcttgatttcttctcgcagataggagaagtgggagcagccgatttcttgatcgtttcttgatcgtgtcagaaaggagaagggaacagcagcagagggcgagagaaagaacagcagaggcgggcacgcgcgaggcttaaaaaaacagcggctcggcttggactcagctcggctcgttaccaatgttgggccggaaccgtgaattgttgggccggcccaaagcagggctactcgccggcgtaacgagaacggaggcggagccctccgccgtggaggtggccgccgcatgcgctgccgctccggcttgccgccggaactggatcagaaacgcggagcagagcggcctggagcgaggagcaggtggatcggtcgacggggcggggagggtagggcgtacatgccgccatctcgccggccggcggagatcgcggggggcggagttgccgccgccggtttgagtgttggtgttcatggcggcgtggcgcggcgcggcggggaggaggagaggccgcggtggcggtggtggtggtgcagcactgttgctgccttgccggagagggaagaggggaggggaggggaggggaggggaggcgaggactgaggagagacggcgacgactcgcgcttccaggagaagcggaggagcggttcggtcggtgggtgtgggtgcaatgcaaccggacgctgacatgcccagcgcccaaatgcaaagctttcctttgtttgtgtttcttgccaaaaattggacagtgtttttaaaattttattttgcggtgacacaatgataattttgaagtaatagaccaaatggacattttcttttgattgtgtttcttgaaaaaaaattttgtaatgataaatttacaagaaacaaaccaagtggatatctagttttattagagagaaaattcgatacatagcacaagaaaaaactcggtaccaaaaaatagcacaacacatttttcacttcgaccaaaggcacagggcaccaattttcttgcgattcatagcactcccgtcacatttgccatccaaacatgtgagttgacatggaaaaagactcatttgcccttcttccccgagcctgccgtgcaattaggaggatgcctcgcattgtgattaatctggggagtactacacttgcaaaaagctaattaggatttaattaattagttgattaattaggtaattaatgaccatctcggcgaggctatggctatcggtggcttgtcccatcctcgccctcacatggatgtagtctttggctggctctggcttctcctcagctgccgccgcgtcgccatcgccatcatctccaacgttagcgaccttggaccgcttcgggctcgcgttcgtggcgtgctatagcacgagttgttggcgctagcgctaccgtggttgcagatgctcccgagccggccgataaggcgccgatggccgccatctcatcagtcatcaccactgccctgcggagacgacacgagcgagctgagcgcggagtcgaagtgcgccacggactccgccgccgccggcgccatcatcatcatcatcatctgttcaaccgccaccgcccatgatggcatcatcgttatcgtcccgtacgccgccgccccgcgggcagcaacgcgcccgcactcgtgtcggcgccggacgaggagatggaggaggagaagtagtcggccatcattgtcgtcgtcagcggcggcggcggcggcgtacagcaaccacatccatccacgccgacgctagggccgcccgcgtcatcgtcgtcgtcctcgtcgtcaagcggccgccagcgctggaggcttgccctggatcagcagtgccaagcgctagacggggtccacctctccgacggtgagcaacgcatccacgtcattgaagagcccgcaccgcagctcgctcggtggtgatggggagacaaggcagtcgcccagcacgccgatggccgccgcgccgccgaccacgagggagcgaaagaggagacctggtggggaacgtggggaacgaagggcaaatgtgtccgatgaaaattttctccacaccgatctaacgccgttacttcaaaatccgatacaaaatgcgatagaagtgctacggggcgaagaaaaattggtggcctatgctatagatcaaaagtggaaattttttgtgctattttttagtactgctttctttcctgtgctatggatcgaattttctctttattatatgaacgattttttttagtctggactagtttggacaacaaactaaaagcccaaattgcatatgcaaatttcacgcaaacataaattcgactagcactttgaattacaccggcttaaattgtactgctgctccgtattttttaaggtcacgtcgatgtccttgtgagtcgatgaaactagtattgtttcgagataaaggggatatctagatccgggtgtaaaggtttagcgtatcacatcagatattatataaagagtcgcatggagcgttcggacactaataaaaaaactatttacagaatctgttagtaaatcacgagacgaatttattaagcctaattaattcattattagcacatgtttactatagcaccacattgtcaaatcatagagcaattaggcttaaaagattcgtgtcgtaaattagtcgtaatatgtgtaattagttattttttaagtctatatttaatacttcatacatgtgtttaaacgtttgatatgacagggtgtaaagttttaaaataagatctaaacaaggccaaagagaacaagttgagaatatgagatgggattcagccattcaggggtaaataaacaaaatgaaatttcaaaaccgcagacaagtccgagcccggtagatggacgaccaagatttctgttgttcgaatcggaaattaccaaatgccgtaagccgtaaacgaatcggaaatggtcagtagactataaatatacgtgtccgagactagagagacaacttgggtgccctcatttgttctcttttgcgcgcagacgagatggtgcagaggccgcgcaaaagggcgcggacgacgtcgccgtgctcgccgccggcgtcgtcgtggcgggacctcccgctggacatcgccggcgaggtcctccgccgcctcccgtcctacgccgaccgcatctgcttcggcgccacgtgccgctcgtggcgcacgtccgcgcgggaacaccgcgcgccgccgccgctgtcgccgtgcctctgcttcgccgacggcagcttccgcggcttcttcccggaggacgcgcggccgttccggctgcccgccgccgccggctggctcggctcctgcggcgagtggctcctgtaccggcgccacgacgacggcgcgtacctgctcgtcgaccccttctccaaggccgccgccatggcgccgctccccagcgtgtcccgtctccatgtccgccacgaccccatcgtcgccgtcgacgagcgagacctgcggtggtgcaggccgacgtggctcccgcgcgagaacaccggcgagccgcaggccgcggcgtccttgctcaagctcgccgtgtccccggccgccgacgtggtggcggcggtggtcggcgaagggaggcacggcaagctcgcggtgtgccggccgggggcgccggcgtggtccgtcagcggcggcgacggctggaggcggatcaaagacacggcgttctaccagggcaagctctacgccgtcgaccacaacgaggacctcctcgccgtgacgctcgccgccgacggcgagccaccggccgtgtcccgcatcgaccgcgtgatcaacggcaagccaccgggggcggccgccctcctccgcgtgacgctgcactacctcgtggactccggcggcgagctgctgctcgttcgccgggaggtccagcgctcgtcgatggtgaggacgcagccgtggcagcacacggcggagctgcaggatcgcttcgccgtgttcagggccgacttccggaggtcgcggtggaggcgggtgaaaaccatcggcgacgagtccggcggccgcgcgctgttcgtcgggcggtggtgctccagggcggtgcgcgtcgccggcgaccggtgggccgatcaggtcttcttcctcgaggacggcaccggcgacgagtggcacacacgggcgcagcgctgctcgctgagggggagcaccttcgggtgcgtgaggccgaatgagctcctgccgttgatgacgacggcggacggccaggatttggatgcgacttggatattccctcgggaggcaaaattgtgagtggcataataaccaaatgctgcataattgagttctgatatatggagtattatttatgaaatgtgtagagtttttgcctcaaagtttaacatggttcaccaaaatctgatgaggtcgaaggcctcaaaatttgaatatcctaatttttatgaatgatatgagcagaaaaaacagctacgaactacgggttgaccttgagcgccacccattgtttgcaattgtgtacatagatgaaatcttttggagagattcggaaaatagtttgccagattaattgtgggtcagctatctttattggtgccctttaagttctttgatgatgccatcagcaagagaatctgcatcgtagttcttgccgtaaaatttaacaaactccatctttggattcatcaagtacctgcgagtacatgagctgttacttaacaagacatacgagatatactagtgatactatctatttcctaatacttcctccgtcccaaaatatcgcaacctcccaatatatagcaacctagaagtgaatttggcctgtctagattagtagttctagtatgtctaattcactctttgcttgctactccctccgtttcgaaatgtttgacgccgttgactttttagcatatgtttgaccgctcgtcttattcaaaaaatttaagtaattattaattcttttcctatcatttgattcattgttaaatatatttttatgtaggcatataattttacatatttcataaaaatttttgaataagacgaacggtcaaacatgtgctaaaaagtcaacggtgtcaaacattttgaaatggagggagtatattttaggatggaaggagtacgaacaacaatggtgtggcaggagcatcaacatatctgaggctgcctaaaattatgagatgtttagtcaatgactgcagtagtgcagtgctataatctcttaaaagaagatacaatgtcctaactacagataccattatactacagcagtacgcccaatagttctccaaaatatgactttgaataacttttatttttacatagtttgtactaaatgaaatatgatcttaacaaaaaaaagtctaaactagttctcatttcgcaaatatattgtattaacacatggattctaaaatgtcataaaaagggaagagggagttattatttcacttttgggttgcagatagattagccgtatcataggacagaacaactctattactagggcatcttgattgcacaccatcagcaagtctaagttaagcaatgatactgtacaatatagattaaaaatgacttacatgacaattgagtgatcaacgagataatcagaaccctcctcctctgtcttcatatagtaaactcgataagcacgagcaacctttcttatctcatcagttgtgccagttagtcctattagatttggatgaaactctgccaaacacaggttgctcgtcatgattagaaagcaaataaaatagaagctgcaactaatttttgaaacggtaataaagtttactagaagaaaaaatgtatggatatcaaaatgaatggttgaagcaaaagcacgtaccattaacatagtcacgaacttgctctacagtatctctctcaggatcaactgtgatgaaaactggcacaacttccatttttgccttttcctctgaaatcaacacaagtttttacattggtttcatgtacagacctcaatcaaagacacagaaatagaaaaaaacaagaaaaatatattatgtgtccagggacatgctccagcaaacacaacagatttccaatggaaagtggatactgccatcaccaagttaaataaggttcacacctgtattcttttatatggatgtcagagtatataaattttatttttgtgcaatttatttgtaaggtagtgaaataatgcacagccacacctaacttgtaagcagcaacaacagcctttggagttaagttccaaacaagttggggtaggctagagtattccaattggtttcaatgaacttttcagtgacagcgtcatggcacttagcacagggacaagatgtttggctacattataagcatgtatacagtgagttatcaacaaaattgtacccaaagcacaaaaatcaaatcgacttacttattttatcaattgccaaagccatcttttgaagttcatctggacaaatgtcagggcagtgtgtgaagccaaaatatagcagagtccacttgccaaagaaatccttttgcgtgacaggtttcccatcatggttcaaaagattgaatggaccaccgatggctgcagtgcctactgatggttcttgcttgacagcacttgttctattcttcaattctggcaaagatgtgccaagagaaaaaaaaatacatgagaaattcaacaatgagcatagcgattgtaagagcctgataaattcctactacatattaaattcccattaagcatttgcctttattcctaccacatagaggtttggcaaaactgaataaaatatactcttaaccaaagaaaagaacacataaaaatgcacagagttcgtaatataggggtttcaactttcatatgcatataaggttttagacttccgtaccatgcagtactttcaccgacctatgaaggtttcactggtaagcaactaaccagcagcatttacatctcttgtttaatgactctaaaccccctccttttctttctaatcatgcgtgcaaagaaaatgcagctatggaggaatcaaatgtagtggttttaaagaaaaaatatgaagggtgtaagtctataaattgcagtaatggactatataagtgaatcaaatggattagattcagaggaagtactaagggtatgcatttgtaaaatgcagctataaaggaagcaactggagtgatatcataatatataaagggtatgaatctctgttcttgaaactggtgtcactattcttatagtcacggcccctatgcaatacaagataaatgaacttaagcaacagcaagccaattctgcgaagttgggctgctcttctgctggtgcagctagttcgttttgcctctcccatcttacatacaacatgagacagctcgcagtaaatgctgtattttctacagtaatacttcagttcaataagtaagcaataaccaagacaaggaaagcacagtacaataaattaatcattgcaaagttactctaggcaacatattccgcaggtaatatcttcctaggtgttacagatagaattccagtaagttaatttgaccacaacacaatgacaatcttctaatgtgtttttaaagaggcatcttagcaccacaacaaacaaaaacaaactcaccatagtaatctaccttcaatgtgacgctttttttccttgtcgtagtacacaattatccctcctccagtcacgagaagcaggagaaagctcaaccacgacaccggctgagagaaagcaaaatttcttcaaataaagcactgaataatgccatttcaagcaattgggccgatttccactacagaggattccagtagaagacattttgaaggactcacccctcctcgcactgattttccagcgtccccttgctcagatttccctgacttcccatcacccccttccccgccggtcgccgcggcaggcttcgcgctgtcctgcgccgcggccgaggcatcggtggagaagcccccgcgcgccaggaacgcagccccgaaccgagatgcagcccccggctcagtgatccgctgcagcacgaacacgcatcaacaactaatcaaatctcccagcctatcaaggtgccaccgcgttatagatgtggagcagaggacgaggcatctagggttcacctgaacctgcagcgcgcgaggacgccgcggagcaggaaggccggtggtggcgagcgcgcgggctaggaacgcggccccgagccgagatgcggcacccggctcagtgatcccctgcaagcacgaacacacatcgaaaaatcatcaaatcaacacagaccatctcgttgccaccgcgttcacgaccgatgtgggtgttctagggtttcacctgaagctgcgcgcggggcagcggtggaggggggaggccgccgaacgcgagcgcgcgggaggggagcgcgtggagacgcggggcgcgcctcatcgttgtcacctcaaagcggcggcggcggcggcggcgcgccggatcggagaaggagacgggattggtcagctagtgcgcagcaaggcgagcgagcgagcgtttggctccgcctcggaggagcggcggcgcccgtgggtttttgggggagacgggtcgagaggttttacctctctttgcttccgacgcaagatggtggtcgccggcatattcctctcaaatttctcccattgcaagggcaaaacagtaatagcacaccaggagaaaatttctgttaaaattggtaaagtagcataattaacttccaaactaccaaatttattagttgaaattccattttatatttttaataacaacgagtactaccacatcagaaaatttactagttgaaattccattttatttttaataacaacgagtaataccacatcagaagaaaaattctgttcaatttggtaaagtagctgaaactaattcctaaccaccaaatatttaaaattttgttccatttattttagtaacagctataatattgttttttaattttagaggtcgttctaatgttgatttcttttatgaattcagactgaatttgtatggaacgatagaatatttaaatttgatttggttggggtgcgccaggcccaggctgtagtgcaacgcctgggcgacacgcgagggcccaagtggcaagccactgtggtggaccctcccccacaaaaaataaatttaatatcgaagtggacacatggcccacatatcagatattaaactgataagaacagatactacacttgatcttagccaaaaggccgagaaaggtatgctttggaacggagccctgcgcctcattttataccttccgcgaccgcctcaccgagctgaacaagcgaggtggtactaaactacgcaacgaagagcaaagcagcaacctgcgccgcggcttccactgcttgggcggttgggcctgaaacctcgcacagcccaagtggccgagtagttgggcccatgaactcggcctcgtttatctctgacatgtgggaccggatgattttaatctgaggccacgttggacacgatcgcgaattcgctctctgacatgtggggccgggtggtttgcatcagaggccacgtcggactacacgatcgcgagggaatttcgcgttgttttttttgtgtttccttcgcttcgaatccttgaaatctcccggtggaaatcggcgaaggggaggagtcgatcgatcggtggagttcgccggcggcgagggagatggacggcggcatgaaggagcaggggatactcctggtgcggaaggcggtggaggaggacgacgccggcaaccacgcgcgggcgctgccgctgtacgtgcacgcgctcgactacctcgccgcgcacctcaagtacgagcggaaccccagggtccgcgacgccatcactgccaagctcgccggctacatcgcccgcgccgaggagatccgcgacgcgctcctccccgccgccggcgacgacgccacgccgcctgcggcagcggcggaggagggcaaggcgaagtgcggcggcggggaagacgagtcggatcgggccaagctgcgggcggggctccactcggcgatcgtctcggagaagcccaacgtgaggtggagcgacgtctccgggctggatggagcaaagcaggcgctgcaggaggccgtcgtgctccccgtcgagttcccgcagttcttcaccggtgagtttgggttcactgggatcccaaacaaattaatagcaaaaatatgaaaagatcaatcacataaaattgatgttactggatttatcattaatcaaactatcataatatgtggttctttttatttaaaatattttatttttatagatattgttggtcaaaatagcatctcgaaaactgtgtcgaagttaaaaaatgtttatattttaggacggagggagtactcaatgtgaattgcagtacctaggcgattgatcaatggtgaaattactgaattttgtaggcaagcggaagccatggaaagccttcctcctgtacgggccaccggggacgggcaaatcttacttggccaaagccgtcgcgacagaggccgattccacattcttcaggtaattgattttcttctcatttcttgtactggtactagttgattagttagtgggttctttcacatttgtgatcgaattggttgcgtgcgttcgattcattatgtagcgtactcagcaaattcagttaattttattttgctcgatagtgtaatcttgtgcctttttgttataagagcaagtttaatagtatagcccactaccggctccaattcatttatagtcaattcatacaatagttacttaggagtactatactattaatatatggtcccacctgtcacatacacattacgttttggggtccgtgctgcagctggccactgctcttctctctcatcgtttatctcattaaaatatgattatagctggctaatagcctgctattgtacctgctctaagcattgttaaatttggacaaaactatggagtgatctgtcatctttgttctgttattagtgtaattactaatctgaagtgacggatggacacacactgcagtatatcttcgtcggatcttctctccaagtggatgggagaaagtgagaagctggtgacgaacctgttccagatggcccgtgaaaatgcaccctccattatcttcatcgatgagatcgactctctgtgtggccaacgaggggaaggcaacgagagcgaggcttctcggagagttaagacagaattcctcgtgcagatgcaggtaattgtcttgatgcagtagcatatctctcgcttcaaacgttcgttgatgaatgcaagtataagacagtggtgcaaaatttagttttgtgtgtgtgtgtgtgtgtgtgtgtgtgtgtgtgtgtgtctgtgaattttgctccatagctagctaagttttttttaaaaaaaatattctgtgaatgtgtgggatgtgcagggtgttggacataacgatgataaagtccttgttcttgctgccacaaacactccatatgctctggatcaggtagaacttacaagacatccatcagttatctcttccagttacattttgcatctcgtttgtgttattgtataagcttgagtgatgatgatcgatcgatcttctttttcccaggctgtacggcggcgttttgacaaacgtatctacattccgctacccgaccttaaagctaggcagcacatgttcaaggtaagtacaaagaagttagcaaaaagagcaatgagattttctcaaacatgcaaccttgaaactgaaacttttgataagtcttgaacctgaatctgaaatccgcattgcaggtccatctgggtgacacccctcacagcctcaccaagggcgacttcgagagcttggctcgccggaccgacggcttctccggctccgacatcgccgtctgcgtaagccacaccacagccacctatcccattttctgtagcagtatgcatgtcaacttgtcatttgatagccgacgatctcttggtcgcgtacgtgcgcgcgcgtgtgtgcaggtgaaggacgtgttgttcgagccggtgcgcaagacgcaggatgccatgttcttcttcgggacggcggagggcgacggcgacggcggcgcgtggacgccgtgtgggccgacgcggccgggcgccgtgcagatcaccatgcaggagctcgcggccaaaggcctggctgctcaggtgagtcctggctgccctagtcattccccgaatgccagaatgccatctctgtggcatatagcttcccttcagccaatagactttagtcgaaatttaaattttacaatttaatttttaaacttgattttaagggtcttttcatcatattttatttacaaacatttgcttttaaattgctaaaacacattgacaaaagttttgttaataaattgtttttaaattgtaaataagccgttgaagcttatgtataagggcgtgttccaaagtctaaacggaggttgaaaacgctgataatggataaacgtgattagcatatgattaattaagtattaattattaaatttttgaaaaaataagtttatctatttttagaatattttttatataagaaagttttcgaaacacaccattaattagttagaaaaacgtgctaatagaaacggggaaagtagccaaaagtgattctcactttagaacgtgccctaagggagacgatgactgtggttgctgatctccttgtctactgtagatcacgccgccgccgatcacgaggacggacttggacaaggtgctggcgaggcagaaggcgacggtgagcgagaaggatctggaggtgtacaccaggttcaccagagagtttggcgaggaaggctagcatcatcttgctgtcatactgtgacatctgattcctgtaaatgatcagtaagatgcttctgtatagctagtgcgcactcgcatcaggattagttgaatgatctgatacaaagtcttgcatgggcaatctttctttgcatggtatcagtgctgtgagatgctaccacgtccatataatttcctatctgcctggtaatgcagagttgctcatggactgttacagtgttaaaggctgggattgcccataaatttgccagccagaaatgaaatttctctacttacaaacatcacgggcctagatttaggatttaggatgcatgtttaaatgcatcatatccctgtgacatacaagcttgctgcaaagacgatgtcacgcttaatggcattggacgcagtctccattttcttatgcaacgcggagttccccattatggaagctgcattcctgaactccctgcaagtttcatccaaccgcacgattgttcttacaatgagaccttcagatacatctgtcagctcacagatgtctgcaaatggggtcccctgcattgaaagatcaaataagaacacactgattctgcataactctcgcagaagagttcccgtgacgtgaggatgtatacctttgcccattcgtagacgacttcaacaagaccgaacttgagattatcacgggcatattcctcgggatctacaggcaccttgaactctctctggagctttcctaatctgattgctgtatcataaatcctagaatagaaaataaacacaagaacaaatggcacttaagtgtgttttgcaggcatttgaaacagaaagcacaaattcttcgaatgcatcatataggaaatgacaacaagcacaagttttttttttaaaaaaaaagaattaaatctaacctctttctggcatctgctagtttcggggtaagagatggttctgatgtattcctttgttggaagaccaatgcagacataatagctacggcttcttcaggttctaggtcatccaactgattctcaaacagacattcggttgatatcaactcctcgccggaattcatttcgcaggccactcggcccttaagttgcaccactagatcagaatcaatgtaatggatttcttttagtacatcgatctgcacacatggaaaggtaagaaatgttactttcacaaaccaatccacgggcgctcagctggaaaacaccagcttatcaaaatcaaactcattttttaagacaatagagtagcaccgtgaaacttccaatatgccaaacaaatcaaaagtgagtggatgaaacgtcatttttttttctaatcccagttctagtgagactgaactttgttgtgccacaaataatagatatctaattccttattatggagcgtgagaaaaatatatatgtttgacatcttactctgccttgaaactccggcatctgttgaagtgcctcatctgacatttcatatttcaaatcattcagctgatccttgtacaccttttgctccttcatcaatgcaatatgctcctttaattttatacaaccatggcacttattttcagacattttttgcagtaatctctggtaagcatagtagttctcaacgagaagcatgtctttcatttttagatctgtattccatagaaaatgaagaaattagacagtgacacaatatactatttataataaccatgcacatcaagtaaaactaagcacatgatcactgagattataaaacataaaacataatgcagatgctactgcataggactatccactatctggtagacagcgaaggctattttatctagccggtcaaaacatcattaacggttacatattataagccatgagaacatggtaatttccctgcagtcctataccttgcctatttacaagattgactaaattgttaataattttgaaagtagtagtaaattatagaacacatttaccactatatcagataactttttcttactagcttggctggaactttatatagcaccagatttcatatgtaatttaaccatagaaaaaaaatgtaccttttattgcatctaaagcagcaggatacttgtttccgtctggttgctcttttataagcatctggacagttttagagtaaactgttttgcttggatcctcaaggagtctgacttgatcaatctttattttgctggcgcatatattcataatctctttattctctattgctctaacttcaaaacccattccagatgcatctcccttgtatggtagcttgatattgatgacacctgaacctttccgtgtactgacagaagagaaatattcatcttccatgctacgttttcctttcgggataacaaagtatccttgtttaaaatcccctgcttccttttcattctggttggatgaatcaggagctagtgctgacgatgtgcaatcaccggtcagtacaagaacaacatattgctttagtgcagcagatggagttttcacaattacaccgagcaagtgatcatcatcctgacacaaaagatgaaaattttaatgtggaaaatgcatctgttgcacatttgctagatacagttccgaaataaaaataagagacagcaataagaccaaaagtgccagattaatttcaagcccacataaatttattgggatccagtgtggcttgtgtgtattcgcgagtcacctgatatttaacatgtttttcccttagtttggatgcttacactaccgaagattctaccccttaattttgaagtgatatagaagacatccgcaaaacttaaataatgattgatgtcttctaattttctcattttcatttcttatgcactacctctacattcataaatatatacagtagaccagaagataatttctgattgattgaataaacagttagcccggcccggcgattgaataaacagtacgagaattggggggaagggaaaacggctataaaaaaataaatttattataaaaaaggaatagacaaacagatagaaattgtgcacaagaggcagcccaataggatgaatacatactgattgggatttaacaacaaccagacggccaggtgtaagggactgttgagaagcaggcaactgcataattgcttccgtaatagactccctgtgtgcctcagcttctaagaccatctcgtagtattcttcaatagccggctctccttttatgcacctgataatataagaaagaacaagacatatagaagaagttaattgttcgcattatactaggtgctacttttcatgggtactttcatacaatcaatgcctatcaaaacaaagtgcaggtaagataatggtacatagataatattgcaaaggaatggttaaaagcccactaaaaaagatatgaagacaacaatggaattctataaacatcctgctgcattttcttaacaaccaaagatcgacagatgactgctatatgcgcaaacccaaccagatacttggtcttttcccctagatgtttccataaagtcgtacccccatccctattctgatgcggttaagaactggaacgtagtggcctaaggctactcccagatttagcatctaaacctctacatctatgtaacatcaccaagtcctgtgtgaaaaatgatggtgcttattaatatattcgtcaatgagataatttctacagagtgagacctaggaagagatgattctctttttctaaaacttcagacaacctccaccaaacacatttgcctactgtggtattttctctcacctctttctttactactccctccgtttcatattataagtcgtttgacattttcaacacataacacacatagtatcaaaatatattcactgttacatctgatgaaactaatttggcgttgtagatgttgctaattttttctataaacttggtcaaacctaaagaagtttgactagaaaaagtcaaagcgacttataatatgaaacggaggtagtagttaactgtgccaaatctcttatgctaaaggtgtgtgctagttctattctaccaaggatggtgtatctagaatttgcatgtccaaatcaaaaatcgaacacaaccatccttgtttgttaacttcctatgtcaatgaaactatgctagtttttatttgcagtttttaagtaggatttgcattgaaaacattggtacccatggtatcaatttcatgaagataggttaatgtctcactcaattgtcttcgtgggttgacgaagcatctgcagaagcaacttttccttctcaggcaaattcttttgtgcatggaattctgcaaaacttctctttagcatgtcctccacctgtgagcaaatccatcaatgtaagccaaggagagaactttttcctattgtacatttagaaaagtaaatggcacacatctaagacatggtgtcactgtcctggggctaccttcacccattgttcagcaatataacaatcggaattttacattaaagaagagatagtgaagtaaccagtgcaacctacacataatgtacaatggtcagggacagtagttcggaaacattactggaccttgaatagtcaaatcatgcatatgccttcataaagaaaagggaactcaacaaagttgtatcacattcactattccctaacttattataaactaattatagatagcacaagctaatcacacactcctcccatgcctatgcagagtcaatgccaaatgcataattgatcaagtagtcaaaacagtcatggaaatggaactttgtgaacaaataaataataaataggattgtttttatagcagacgcttcattatatcatggactaactcatcacaccttaaaaacatatgtttagtttatatttcagttttcagtcttcaaagttcgaacagatatttttaatgtgtgactggatgatcaaaagctcaagaaataccaaagggtacatagccaaattgaaatatggaattgaatttgaaaaaagaggaatggccaagccagaaagttttctaattggtctatataagtgtaccttgagttcctccacacgtagaagatgcagtatcatagtgtatgttaaccgaaattgagattctagtcgagttggttttccaacaatcaaattcttcaaatcactttcttcgggaatttcatcacgacacataacgatcactgtaccaatgttatcaagccctctcctaccagctcgcccggccatttgaatatactcccctggaagtaacttccgatgttcttttccatcaaactttcttaaggaatcaaacacgacctgttagatttgcaaaattaagtcagagcattgcagcttgcttaccagatccttgagctaagcatgggaaaagcaagagtaactaagaactgcagttagcttaatttaattttgatatttttattacaaagaaaaaaaagtatgtatctatctgacaaacatttatagtttacataacctgtcttttcaacaaaaggaaaactggaaatcatgataactgtgcacaacaaactgagtttttaaaacaacaaaagtgtgtaacgaatgtggaaagagactagtcatgcattcaaaattggcttagtccaaagcatgttaaacagaagtctgtctacatgcggtcgacattgcaattgtagatgatgctagcatcaataagcatgacaagataaaaggttgactttcacctccaacatcatgagtaaagagtctcttcagcttttgcattactgtgaaaatgaaactatcaaaatgtttaaatatcagaattagcagaagttatgcatgaataaatgatagaaaaactgattgtttcattcccattattcaaacatatatgggaaaaactaataagtagatgacaaaaggcaagtggtatggtcacatagagccagatcttgcataagctttgtttgacacaagatgaaaaggtatttaaatcctcaatatgacaaaagaacaaatagagcctcaccgtccttgctggagcattaacgcccatcgcaaatgtctcagtggaaaataacacctacaattgactccaagtcaaggttgacattcagttaaaaaaatgaatggatcagaacatgcaatatttgattaatgtaatgttgaaaagaataaggtagtatctgatagatggcatcgatgtgatttgatctcaaatgtcatttcagtgttacactgttcatttgttcaatgtgttgaatcacgtaaaagctttgatagatgacactcttattgagtattgtgcaaaactgacttagaaaatgcaggatatgatggccccttctttttcataacatcgacttcctctagtcataaatagttgacgtttaggacaagatttggttaaactttagaaactttgaccatcaatttcatattagaatatgtttatagaatctagtaagtttatgatgttatgatagtacttttcaaggcaaatctacatgaaccattttaaaactaaacatttgagaagttattaatggtaaaaaatttcaaaagtttgactaaatcttgtcctaaacgccaaatatttatgaccagagggagtagcaaatatcgaaaaactagtatagattatgtacatggaatagttctcttcaagcttgaagaagtttagatactttctaaagaaactaactaccaaaaaaaactacaacatgttcaaagtttaaccttgatgacgccacgacaaaacagcatttcaacaacttctttgacgataggaagaagtccagcatggtgtactccaatccctctacgtagaaggctttgtatccctacaacctaacagggaaaccaaagtttcaaacagaaacaaggataagattgtcagactaaaatcatttgtgctactagatcacctgtggaaggttcctatcagatcctttaaggcgtgaaaaggccttgtcacagaagaggcggatttcacttttctctgagttactggtgagatctgcaccaaacatgctctctgctgatctatcacatcgattttttgagaagcaaaaaattaccacctgtcaaagaaccatataaaatatcagaaaagctcttgtaaaatgtaaaatgacctggcatgatgaatgggaacagtaatcaatgaccaatatgctgtgaccaattgttacttcgcaattgattacgtacttcagaatgcacaatggagagtggaataataaaatttgatataaatttaatgctcaaaagaacaaaatgttatgaaattcattgctcaagataaatgccataattttatcattctcacatacaggcacgagggatttcttcagaaggttatttatgaggggcatccagaatgaagactctgatctccgtggcccagaggtgctttgctgaacagcagcagctgatgagctggcatgatggtgctttggatttttctgatctctacctctactagatgtatctggatttctgccttgagttccagcacgtactgcagttgttcctggttttgaaccaggtttcattccaagcttgctcgaatttttctttttaaaaacctccttggcttctctatatccttgagtaagaaatgcatccttctcacatattttgaacacttctccggagtagaacaaacagtgctccaggggaacaggccttttgttggtcctgatgaacaaatggcagcaaaatggtatgatgcaaactgtaataggaagtagtttaaaataattctgcacttacaaaggtaaagacactataatccactcaactgatgtatagtaatagataataatacgctgtattattcagttgtaagaaaataaggtgatttggtcttattttcttgaaatgacccccatccagtactcagagtttgctcaattaatccctagcccttccacttactgagatttgcccaattgcacaccttcaacagttcaactaatgtattcagtatttcagtacatgcaccaactgaatcaataaatattggaatctcaaactagaaaaggcaattaaatactaattactccctccatccaaagcattccaagcgtttgaaatttgtccgcaaatataagcgttccagaaaaatacttgtctcatcaatcacgtctcattcaaatttcttcccatcttacccccaaccacccttccaccgccatgcatccctcatttagtgaggggcacaccaatgtcttttctcaatctttgttaaacaacctagaaaagcttatatttggggatggagggagtgctatctagaattagtgatatagctttgtgtaagaaacctacataaaacaacaaagatgctacttttattgatataaaaatcttctaaaatatttagcaagctattgtgttttatcattggtccttagggaaaaaaagaatccgattagagaatcctcacggccatagggttttaatcaacaaaaatagttgcaatgatgagtttttagttgcacaagatagtacattaaaggcactcagatcaataaaactacaccagtggcttgatcgcacaaaataaaataccttaaggggcctacaatgcaattttgcttgcttaaaagtgatataactacacttacgatgtgacatgaattttcttctgctttgttcgaccaatccagtcagcaaattcaactgtgtttggaacctaaatagaaatgttacagctcaactccaaaataaatatcaatctgagagatgatatgaaggtcacaactcacaagcttgagctttttgtaagaaggaaaagaaaaaaaaaagtctatgatgtatttaaaagatatttttggcattcaaaaaccatattaacctgggctgagccttatcaggtataagtggttgtatcatagtagcttagtagaaaactggcacaaccatactttctatgaaaatcaccttaaggtcagagtactccactaattattttaagagacagtaaactataaatggttctattattctatttctgagttactatagttaatccattaatgggctaatggtatgtcatgcttttgcatacttgaaatgattcttaataatttgagtgacagtcttagcagttgatagcaacacaacttagatatcacagttgggtgccaatagttaaacacaagtattcactaaatccataccgttgccgaaagaaggacaatgttgatgtgcttcgggagcattataataacttcctcccaaactacacctctctctgcatcatttacataatgcacttcatcaaaaattacctgattgcaaaaccacgcacggcacacggctccataagtttttaaaatataaggtgggaagttaaatattacattatgaactatgaagaattgagaactgagacagcgtacccattcaatatcacgtatgatgtcagcacctctgtagagcattgaacgtaatatttctgtggtcataattaagcaagttgcctctggtctgatactgacatctcctgtgagaagtcccacgtcaaacttcccacagaaatctcggtatttttgattgctgatagttttaatgggagcagtatagacagcccgggtgcaatgctgcataataacattagctgtcatcacaaggaccatgcaaacattgttttattgagatgtactatatagtaagcaaatagaaatagcacaatgaagtatgtacaaatcaggcattgcaaatatcgatctactgaggaaacgcaaaactgagctcttatcagaaatgcagaattcaaatcaactaaaagtaaatataagttatgttcatttttacaagcactgggttaatgaggtactcaagtgaagggatcggtggtttcaaattaacgaaaagtagaatacccaaaaggaacagtgaagcaagcgtacttttgttgctaaagcgaatgcatactctgcaacaaccgtctttcctgctgatgtatgagctgccacaaagactgattcacccttctgaagataatatatagcctatatttggcagaatagaaagttacacatcagcaactatatcaagcatttagtagcatatattttactaacaaaaaggttatggtaattagggtctgctcacaataaatgattcccacaggagatgtggaggaaagaatgcatttctcataattttttccttatccgaaaattcaatggcaaaccttttgtttcaaaaatatggggctttttacttctttagagtgacaagtcataggccactcacagaagtggaatgcagttgctggttgcattgaaactattcttttttactatatgtggtacttgatagggaaaatatgcatagttaaagtattgctggtgcatggagtttttatccttcactggtaaaacatggttgtgctatcaaaaagtccatgttaacaaaatgtgcttgtagaagaaaatattcctgtcggtattgaaaaataagacattgaaaacaaaggtgcagacatttatgaatagcttacctccttctggaatttgtctagttcaaatggatactcaattgccatatctggaacaagtttatagaagttagtcacaatgtcttcatccccaccaacaagtgcccaaacctgcaagtgaaatagaaacagataaacatcactacttcatatctatgcatcaatgaaatttatggaatgagaagcacaattgagaaagtgtccgacaaaatgaaacacgaaatgcacttaccttgccctcctttgccatgctgccatcacctgacccacttgaatctctgctagtatctttaactgaggacaataacatttgatccaagtctgattgaggttcagaaacatctccttgggcaccacctttctgtttttcaatgtccagattttctatagtttcagaagcattttgcagtttgctaatattttgtttatcaacatctgaagttggaaaagggggaaggttagcatgaaaccagagatgacttaaaccttgtagtaaaaatggggatgatgacagttatcatgatttaccacaagagaagatattcatgtgaatcgaggatatgatgtatgaggatgataaatttaccattggtctcctcatctccaaccaattgctgaacatgatcttcacgcggcaccttgtcgtcagaatcttcctcccatgctatcttgaatagatcatcaaactgcactgagtacttatcctgcaagaacatgagacattcagattataatgtataatagcaaaactggcaaattgtggaatcctgaattgtttagaatatgaaccgaggtaccatggtgtcatttgatgaagatgtggattgctcatctacacgctctccatcctggtaacacttccaatggcttttgtactcctataggaatatagtgcacacaatagcggcacagacgcagcttagcacaatgacagcaaacattactttgcaaaacaaaccaacacactattaaggatcaaaccttcaaattgcccaggtccaatcccttgcggaatcctggaggattaacctgagctggccctccgctcataagctcgcgcacccaatccccattgcgtgcaccctctggaaatgccttctccaaagcagcagccgcagccgcatcatcatgcaggccccctgggcggaacgggcggctgttcacgctccccctcacgaaatccttcgcagggccaggcatccgcggcgttatcccaccggtgcccgaatcaaacacgtcgctcatatccatctgcacggactcaggatcccacacttgcgactcctgccgcgacgacgacgacgacaatggcggccgtcggcggcggaagggcggctcccaggcgggcacgagcatggtgcgcggggcggagggctccagcggcggcctagccaactcgaaccaatccaaatcccacaccctcgcgccatcggccgcggtggggaggtggagctccgggttgaggtagttggcctcgaggtactccttcacgctgctcgggctctccagcgggtacgccggcggctgcgatcgccatcacacctccgatgggtttagggtttacgcttccgcaacattgagtaaaacgcgtgatttaggaggtgggggagcagtgggtcgcgtaccaggacgaactcgggtatagggctgggcggattgggcgtggggtcgaggcggaggtggccgccatggccggagaagctgacgcggaacggcacctcgctcgccggcgacgaggtggtgaggtcgcccatggaggccgccgccggtgaggaggcggtccgtttcccttttcgacggaagacgaactggtgctttggggagtttcagctttacccgcagaaacaatagaagaaattggacgttcgatcactgtttggattggatttgttaaagtgtcactccaaattgatatcaaaccgtttcttttgtcatattcgtcatttcacaatatttctattattttctgcagttgacctgatcaaaatatccctttgattatcgtcggttactcctttgccatctccatctcctgcctacatgaactaaacttgtcgtccgtttattgttgttgaaggagacggctgaagacctgagctctccccgcccccgtcgcggcggccgatgtcgtccccgccgatgacgcgccgctcttgccgaagacgagctcggagagaccgttctatgacaacaactggtgcacaacccgtcgcatctgccgcatccaacccgccctccttcctcctccctgtggtcgttaccaatggcccgctgggcgcgtccatctcatcttgtttaactgaacgaaggggtattttgggcaagtcaagtccgaaaaaggtagaaatcctgtaaaatgacgaatatggaaaaacaatggtttggcattggttggaagtgactttttaacgaatccaatccgcggagtggcatttgagcaaaaccctcttttggcggtggtggaatgtccaatttctcgaaacaatacatactccacctattttgagtttcactgggaggaaaatgtttttttaaaaaatatactttttgtcacgatttgccaatagaaataccctttttgacgaaatttcacaataatccgtgcaacaatgtaatccattattttttaaaaaaaaacaacccactagataaggtaaaccattttccatgttgaatattatcaagtgattgtattggtgtgtattttaccgctcaccgacatcaacaaaaatttgtaatcttgtcaaaataccatactcatggagcatcaatctttttccacctttgctcgtggagtagcaccttttgccatcaaagtctcacctctgctttatatttggactaaatatccaaatcacgagacataaaatctattactgtgatgctaaatagagtatgatgtttttctggtcagtattgtttctagtggattcttaatcttactttaactgcctattttaaaaaggtaatggaaagagaagtgaagaagaagaagaaaaaaaactctaaaattaacaaactaatagcactatctttaggggccatatggttaatttagagttttatactttttctaatctctccgaagatcctacatccatggtgctatcatcccacatgccattccccattcgcctcatagaattcatcaatacatgcatgcatctacatttttttctagctttctttatccaacgatcatgcaatgcttgatcgcatgtctctgattcttgatgctaatacaataatctatcaatcgttcatactccatgtcataggggtcgccggccttgggatcctttagagagcccgtcaatcatagcgacattggctctaagctccttgcaggtgatgttgaatccgatgatggggagatcatcaggagaaggaggaggaggaggaggcgacaatgtgttaatcgatgacaatgtcctcgactcattgccattgccacctcttcccatgcggccgaccccacgatgccgacgacattcatcgcggccacaaaggcatgtcattgtcgaattctcagggccatggacactgcaaccgtggtcatcatcacatctcaaggttccatcatttgaattatatgatgaattaatcataataataagtgcaaatcaagttatcagtatggcttggattgccaggaggaagaagaagcaaaggacaaaacaacaacgttggttgaggagcttgaggggaaggcggccatggcagaggcgagattgaggcaaaaagaggaggagaatgctgaactgaaacggaagtttgagggttaccatgttaggtggctgcaacacgagattaggctcagctctctcaaggaaaccattgatgaacaaatgatttctctacaggtcagcatcataacactatcaccagctacgtaattaatcaaaccatttttgcagccattcacgtgacaaagtgacaataatctaactaacctcgattgattgtctgaatctcacaggtggctcaagaatgtgtagaaaagagatcacgtgaaatgttatcactatatgaccgccaagaatcctcggaatcctacgtgaagatgtctaaggaaacatcggcgaggttggcgcacagctctcgccattatgcgggcattgctcgtggtacatgcacggagttccgacaacagagccaagcactcgtggagtcaagggagccatggcagccaagcactcaaggtgggaattccattgatgacctcgagaagctcaagtcaaatttttgcatgtggaagaaggattacaaagctcgactacggaaagccatggccgctgagctagatttagagggaagacatcgaagcatatgctggatttaaccacataacgtataatcatatatatgtgtgtgctattgtttcttgtagtgataaaaactagtgtggttttacatatttgatgtttttatcaaggcatgcatttgatataaaggttgctaaaatgctaagaacctcctataaagtgcagagtaaaaacaccaatagaaataagaatgttatgtttcatcgcgtcaatcaaatccccgtaccaattttatggtgcatctatttattaaacagcaaaaatcatttggtctcatggtttagataagtaaacatctcaacgaccttgtgttggagacggtatgagcaaataaaaacacctttaatacccttatgtgaggaggaaactaaaagaacttgcttacgccttgtattttatacttgttgacttgtcaaccgaaaagaaagaaaacttaaatatagagttttttttgttgaggtcaatttttcatatttaacctttaaaccactcataatacatatactacatttttttgttgaacaatttctcacaatatcaccgctattaaagctcgtggtcacatgccatgaaggactcaaaccaaaacccatgatagcaattgacctcctactacacaactacacaagccaacccaagagatttgtagtgatatccacgtttttcttgttgctaaccacaattagggacggtggagattgtatggacagatccacaataatgtcccttcttcctttttcacctcaaaccaacatctgattatgccatcttttactgtgctcacaaacatgagatccctttccctaattggtgacaaccctgatgcagccaaggcaaaagttggaggagatttggtggcacactggcactggtactcaactcaagatcaatccaactttttttgacatcataagttttatggatgaaatcacttgcctttgcaacaagatttggatgcatgtcatgctgtggttcgatgttgaacggccgtgtgcttcaaagcgggaacgaagaccactgtaggtgagggagaaagttgagggatggtgagatgagagggacagccataggttatgagagggacagccttctattgtacatgctcttatacaaaattgtcctataaacaatttacggtgcagttgttcaaccactgatgtatatatatagtggtgtagcagctgtagaatcgcatgggtgcatcatcagaccaaaggtcagggttaattttcagtctcagaatctgtcaatcaacatattagctggacaaatcctgtaaaaactaacctttattgaaaggaacagcatgatttgacagccatggagacgcatgtagtaacccctttttcccggcgtggctgtgtaccatccgctgccaatcagaaaaaaaaaaggaaaatatatgcttgcttttctctatattatccgtcccagctagtacatctacacggttattagaaagttcgctcaaaattagcagcagtgaggatattataaaaaggtttattgtttattaacccactatcaaaaccaaatgccatttcaatttggtgcctaattatttttgccctggcttaacttggataaactaagcaggcagtgaacggaaggcactaaaaagggtcaaaaagattcatgcgtacccccccgagggcaaatgtcccatttttgaatcggatcaaacttctagtgtgaaactttatacacataaactttatatagataaaatttatatatatgaacttcaatatctaaatcaaacttggttccattttatacaaagaaacattccacattgaaaccttatatacataaggttttcctaaaatagtatttctacacacagaagacacatctaatttcgacatggctccaatttcaacatcaaaactttatttctaatcaaacattttctttacatagaacatttttacatataagctgtgtttagatctaaagtttggatctaaatttcagtcattttccatcacatcaacctatcatatacacacaacttttcagtcatatcatctccaatttcaaacaaaatttaaactttgcgctgaactaaacacaaaacacagccatagaaacatgaaccgcgcacacacatgtgccgtgcggaacacgcttgcatatttaccacgtcccgcgtaaatgtttgcatgctacacctcataacacacacaatgtttgcatgcaccgttcccgcgcaaatgtccacgcataacacccagcgcgcacatttgcgtgcaccattcccgcgtaaatgtttaaacgttcgcgcattacactacacactgtacacacatttgcatataccgcgcgaatgtcccttcataaacacccaaaaaaaaggtgtgaaaacaaaaggagaaaaaaaccacgaggaggaggaaaaatgggaggaaggtggagagggccagcgtgtgaaaagggctcggcaccgtgccggcgacccgggccaaaaaaggcccgggtgatgcgaatgtgcggtgcggtgcggtgcggtgagccagaagtagaccggcgcaccgaggctgggctggtagtacactacactggtgaacccgtacgagccgcgtgtatttagcgagcggcagtagcacggtggagacggcacacgcaccgcttcgccccgccgaagagacggacgcctccacacgtctcttcctcttccttgatactgagagagagagagagaggaggaggaggaggaccagccatccacccgcgcggccgcggcgaatccatccaatccgcgtcgatgcggcggcggcggcggtagcggggagggggtggaaatggtgggggatcaggaggggaggcggcagcggcggcgggggtggggggaggaggaggaggaccgcatctcggacctccccgacgcgctgcggctccagattctgagcctcctgccgctcaagtcggcaatccggacgggggccctctcgtcgcggtggcgggggttgtgggagcagcggtggcccgacccgtcgtcgctcgacgtgcggctgccatcggggggaggagccgcgtcggcgtcggtggcggcgctgcgggccgagcacctcgcaggcatcgaccggcgcgggaggcggcggatggacctcttctcgctcgccttccacgcggggcagctcgcgccccccgagctgaagcggttcatcgagtacgcggcggcgtgcgacgtggaggaggtgcggctgcggctcgacggcggcggcgggcgtggggcgagagggggcacgcggcggcccggcgcgctcgccgtgcacttccccatcgggagcaagctcctcgcgcggctgtcggtgcgggggctccacctcacggcgtccgccaacgcgatggtcgccacgctcgaggtgatccatttccactccgtctccctcaccgacgccgcgctgcggcgggtggtctccgcctgcccgcgcctccgcgagctcgagctccggtactgccgacacctccgccgtatcgatttcaccgtcggggcctccaatctcaagagcctcaccgtcgtcgactgctcccgcgccacggagctgcgcgtgccatcggcgcccctcctccggtcgttccggttcagcggcgcgttcctctgcagcaacattttcggtagcaccgcggattgtgtcgagcatctctacctctgctccggcgggccggagacaggtttgccgcgcaccaacttgccgtcggcagtcccccgcctgtcaaacctcaccgtactcaccctatgcagcattgctctccaggtctgcccaagtatctatgccgtctttggttgcgtttcattttgttgcttttgtgcttatacttgcacgccttgtagtatgtctctgcttcagtagccacccccaacgtggagaagagcttgaacagcttgagagagctccagctgctcatgttcggaatggccaactccaacctcgcagatatctatagcttcctcaaggcctgccgttgtcctcagttggagaggctcttcgtgcaggttgttatttctaggcaaaatgcattttgttgctagtttacttataggtgtgtgccatttatgtacttaacatattgtgttcaacattgcagctcccaacaaacacttatgattcgttcacgacgaattatttggaggtagcagaggaagaaccgcctgaaggcggattagaaaaccttcggttggtcaagatgacaaacttcaagggttatcgcaatgaactacgactggtggatttcctgctgaggaaagctagccgtcttaacaaactgttcctgattgctcccaaggaggttcacccacaaggcctccgaaaggtccactcggaggcactgccccattttctcaagacagatgtattgcatcttgaaagagcttcagcaatcgcccagataatttttgatgagtctgttagtcctcagatactacccttgcattcggaggtctttgtcagagtttagctgaaataagcaattgcaccgtagtttaattgctgctccttaattattaccattatagcttttaggcaacagacatgaaaaagatctgcaagcatacaaagtttggtataatatatttgcaatttatgttttgaaatgtctgggtaagatggttgaaatttgtggtattccagtcctcttatgatcctcgtgttctggcaagatgattgaaactatagtttggtataacataattgcaatttgtgttttcaaatgcctgaattttccttgtccaaaatcccctcaagagttagcttatttaaaatttgcttttggcatgccatctagctaaaacatacaccaatgtgtgttatgaacataactgtgtgttatgtggtaccaattatctgtaagataccatttataaaaatgatttaccctggaggtggactggtatgttttgcactctaaaattggtgagctattctgttgcctgatcttcatgacacatgtaaaaaaatacattagagaagaaatgaacacggagaaagtgtcttaccgattataaatttggacaaactacagaagttatggacatcaatgtagcatattcaattgttcgtgaacgtgaaaaatatggtttgaacttagataggacaggtggcacggatgacagaacacgtgtttctacattcaactaatgtgaattgatatgggctatgtgttctttttcccactccttggactgtatgtcacgaattaagttacctgtgcaaccttaagagtggttttcattagcggtcctcagagaatcctggtcttgtataatgtgtcttatacatctttcagcatgcctttcttgcctgtgaaactgtgcgtatatcttgtttaagttggtaatgcacgaaagttcccaaggagtttcttaagaaacaaatactttcttaaaattcgtattctgtgtatattcttgacttatgttcatcaatagcaaacatatttcagtatagaagctgaaaaaaaagtggcgcagatgtactcaaataggaatgtaaatttgaatgaactcttgctcttcactctttattcactatagaggttctttagtcagttggactccagttttttatacttcatgcaaatatatactagtataagcttgtttgatgatttctagcatctatgctcatttggtgcttggaatagagggagtcctgtactgatgtttatgcatttctattttgtgtggtggttgcttgcttcctgctgttatgaaatgcatctgagttctgaaggagttggtttgattcttctttctctcccttccttttctttctttctttctttctttttaattattttaaatggatggaatgctttctaaattccaaccaatgtatttagttttctgatctacatttattttaagtcagtgtgacaaagttacgatgaaagatagctttgtgtcggctttgtatggaagctgaattacttgtggtgttggtgggagccagttttactcgatactagcaacattgacttttcatgcaatcatatatctgagaagggcactgatgaaacatatggtggtaagttaagtcatatggaagcgctatataactcatgctcaaaatgtggtgttgggactcttatacctgctttttatttggggctagtatcatggcctcttagttctgttaaatacttgaatgtttgggtcatttggatgctgagggatgagatcaattgatgaacagttcttagctagctttgtttcttggctttgcagtgttggaggaggcatgactgaatgaaccatttcatgctgatgatttcctgatgtaagctcacactgcccctaagaaggtggtattacccttggtctgttgggttagctggggggacctgggtggagcatctttatgaaatttcttatgtgctccttatatgaactgaaagtcatatcaccttttattgttttgcatttgcaccttataatgccagtgtgccacatagaactattgagccacacagcattgtgatttgtggaatgatatgggtaatgttgataaaggtatccattatgctacaacctattttatgcatttttatgttgaaaagcactgttactaatgtgtttgtattttgctatattttgaaccctttaggatatgaaccttacatacatgtctattgaataacactttccttgccccgcaaaaaaaagaataacgttaacttttcttgggcttagtgatttctaagctttatgggattcacactttctctgtcgtgtgtttctgtagtagtacttgcatttttctacctactggttcacaggcgtttaaaggctggtcaacaaacagtaacataccatgacaagaataactaggctattggtatttagttgtgagataattttctgtaaatatatgcattttcatttttttttgtcaaatccttctctttgccttcctaggttatggatatttagataattttccattttgatgtcaaatccttctctttgcctgacacattcaaagatgactttatttgatgactttttcatgcttacatagctacttatgattgttctccaaagcacagtaaaatatcgttacatccagaacaaatttgatatgccatgtcataatttctgcaagttaatccatacttctgctttatattaatatagattcttgggtttttatcagaagttgaaagcaacgttgagaattccaccgtttaatgttcaatgcctattgactcaaggggttgtacactacactacactagaagcacctgtacagatccgattgtggctgggaggaccaaggagatttagttgtttggtaacctattgcacacaaatactcactttaaaatcctaatacttttggggtgatttgtgtttaattagacattttcatgcaaacctaatcatttcttgagaaataatttatggtagcacctccattgataaaatttaccgttggtgatttctcaatacttgagaaataatctatatattcttttattttagtctgcaatctatctaaaattaacttttcaaagatacatgagctacatatatcctctactaacagtgccaccttgcaaaaaaatcaggaaggaggagcagcttacaagatctcaaggaatgtgattggttacttggaacgccttcacatatgtcggtgaggaaatgaagggatgtcctactttttgtgatctatggtggcatggtgggcctactgtgattgcccctgtagcagaggtacatgattttattattgaaggtctcccacaactttaagttattcagtctgcatgttatgttgaatatgttaggtacatatttacatatgacaacccctattttcaatactagctacaattctttttcaagatggctactaacttgattaagaaagactgggtaaagaatttcctgttacaagtgtatacccagcctcgttaatatttcttatataaactgaagtcagcctttgccaattagaataacatcttagtagaacactatactacctctgttcttgagcaatagacaatttgaccattccatgtagaacaaggcaacaaattttgtgaccaatttgcccttggcaattgttaggagatggtattaaaaaaaagaataaatgggaggtggggggaaaggaatggatccaaaatagaagtatctagaggttttctctatggtggaagattgatttagacccacaagtgtagccatgggaaagtaggggcaaaattggattttaccaatgaaagtatggtggtgacaaatattctgaaacaaatgatttggtcaaattgccagttattcaagaacggatggagtattatttgcctctgataaattcttttcttatatcactcattttgttcagttaatttaattacataattttaataataagctagtattacttcatgctaattttgggctttgagctttatagggtactttgtaacagatgagttgttctggaacagtagatgactaattagccattagaaaccaatggtttggtttggcagtcaacatgtacatactagaccaattccctggaccttttgccctaaaataatatgatgaccattgactatatacatggtaataccagcaccctgtccttttggccttttatacaaggagctgaatgcatttttggtcttttactccatagttcgatatttttctgatggtacttccctggtgtcaaagcaaagcctgcagaggaagcacaattcttattctgtatgataatgatcaactgcgatgaactcatcaaacatcagttggggaaacttattcgaggctgttgtttgggctgctggtcttggaatcacctctttttttggatttcattcatataaatgccttgttggtgatcatatatcatatatggctcatcaagacatgaattgggaaaggtttgttgcccaacagctcaggtggtttctacagttctatttccagtcttccatgagtattttcattgttccatacgtctatactactgacctgtaataaatataataataaataaccaattatatgtctggtacatacatatgaatgctctctcaacgtctcttaaatatttgtgtcctttgcagtaccttgcttttcttttgtccttccatttttcactgtattgtttgcctagtatacctgccttttcatttctcctcccatttcactgtaccatttactttatgatgaatggtatgtgcacatcttatttaaatcagtgtacagcatacgtgctactgtgctagtggtggtctatgttgaaagttgagactactttttagtatttgtattccttgatgtcgagctatgttgctacagggactacaggatcaagttatttgaagtggcgatttagagccataataataataataattagtcccctctcttccagaaagtggtgcgggcaggtggacatgtctgggtagtgttcacaattcccttaaaaggtgggctacaaaatcatggggaaacttgtaaattaaaaaggcacaagcaattagccaattactggtagtctttgagtcctattggtgctcttctctttcttcacttggtgaccagtttttgtattttatttaccttgctcttcaaaggctcaaagctaccaggtttcagcatgaaggagatgtatgttacttccaagttcatccatattattttgggggtttaatttttaagtagtggcagctggagaaggattttacaaagacgactgggtatatcttgttatcccatattgggttcttccgggagcaaaactgcaaaagcactgtattgctgattggatggcccccattacaatccgtatgaccttttaatatctgattctggaggtagctgagagtaataacctttgagtatctaggagcagcactagcacgtacactgcacgctgcaaattattatactaaaatgaaatgcattttctaggtataaacatacttctataaaataatatagctgcaattttctcctatggatttcctttgtatggagaggatgcacctttacttgttctttatttacttactacctctgtcctacttagacttcaattttttcttatgaatctagacaaatatttgtctagatgcatatatatctagaaataaagtgtggtctcaagctcctagtttttttttaatttgttctacagggttagcgacgacagtatgtctagcttatccaatcctgaatttaggagggtacatcagtagtacatcacatgggaggtggtgtgccactgggataattaggtaccacccgtactggtcagtggtcgtacagtctctactactccagcatgctggtccattttccctgctcaatgctcacaccaaccaattagctcttttccagcacgtgcacttgctcttatcttagctctccgtaccgtatctaatctctttgtaactacctttataaatgaatgcagtacacagctaaacctgctggatacagacgagcagagggcagcatggggagagtctgaaacaggtccagtacctcaggtcctaacatgtgataaacttctttcacaccctcttatcatttcacatttgcattttacagcctattactgttatgcattgttcacttgaactgtgaaaggactggtcattgggccatggcttgatgcaaacattaatctttcctttaatacttccattccaagttgcttttgtcatgcatatttttggggtctgtaggtccaccatgcagtagcgctcagattctgcatcatagatgaccccattatacagtgtttctttcaatgcaagtttgtatggtactactgcaatctgaaaaaaaagggaaaagaaaaagaactgtttgtttggtgccagccagctttttttccataggacaaaacaaagaagggaaaaggtaaattgaatattaatattttactaaataaaggcatttatggaagagttgatgtttgcacatatcacaatgagaagcagtttatatatgattatcaggtgtaatcaaccctaccgaggtttatattaaggatatgcttcacaccccagcactccacccacctatcccactaaatctaacccacttcggtgcagcaaaagatgcctcgagcctgtggcaggcagagcagtgcaaaattccaatcgaagaaaccaaaaggaggcagcaaaaagacagatcaaatggattcaccaactgatccattcatctggccaggccagctgggctttgcatatacattgcagaccactagagctataagaaccttatcattatcatttactaaacagaaaaactactatctgcatatcttcaattccatgtctccaactccaagaaccagttttgatcccaacaggagtgcaggaatggaggtagcagaatgcagtgagaagctgcaaattttaaaggcatcggcttcagcatcaatggcttattcgattgttcagttcccagtcaagtggcaatccatcaagtacaagcttcagcaactctgttccaacctgaatgcgccaggagacgacggcagctgcaacgaaaatgtgattcttgttcagtttcttcagacggctacagcaacagtaagtcatattcaagctattgcttctcaatgcagcgatgaatcttacaatggtggaaggcttcgtctgaggagtgatttggacagcatcagctccaagcttgatatccacctgaaggacctcaaggagatggtttcctccagaatttctgtgcgttctcaagctgtcatcgcaacgaggcctgccattggtgcaagcctaagcaacaagaggttctacatcaatgatctcttcttgagggtgaggattggggatttggctcaaagaaaacaagccctggtcaccattggagagctcctatctgaagatatcgagtatgtcaagattgtagctcttgacattgataatagcatcactctcctgatcagctttcttgaatcaggggatgcatgcattcaagaacaggctgcaagaattgtctcccttattgcaggctatgattcttacagaggaatgcttgtgaaagcaggtgtggttgctccacttgtccagttactggatagtccaagctgcaccagcactactgtttcatcaagggagagagcagctcatgcattgagggagctgacgagcaactccgacaacgtctgggccgtctgcgcacaaggcggtgtcaccgtgctcctgatcgtctgcgccaatgtcgatagcaggggcaagctggtcagctccgctttcgcggtgctgaagaacctgagcagggtggaggaggtgaagatgttcatggtggaacaaggtgcagttatggagttggtgaagctgtcccgacaaaaggaggaagaacgcaaagttggatcagttgagctgctccattacatggccttggctgatgccaatgtcagacaagcagcaatcagcatggggatgatccaatcactcactcagctgatgaaccctgatcttccatactcatccaaagccagggaggttgctctctcagccattgcattcttctgcctcccttccaaagctctgacagatgatctcatcagctccaattttcttagctggcttcaaacctatctcaacaatgttgactatgctgtcctggaatgcaccctcaacattctggtacggctaacgaggatctccgaggaatacagcaagatggttggcagggcagggttcatgactgccctggtaagctcacttggagccaaatcttgtcaggtcagggagatggcagcacaagtactctgcaacctactgttgcttcactctaaccgtgtagttttcatccaagatggtgataatctgaaccggctgctgcagtcgcttgagcacggtgacggcaagacgatggcgaaggatttggccatttcttgcctcgtgtcgttggcagagaccagtgctggaaggaagaagatcatatcgtctcaacattttgtcagcttgaaaggactcgcagactccggtgaccttcctgccaagaagatcgtgaagaaactctgtgctaacaagttgcaaagcattcttacgagaatccggatcacatgacttccttctcgcgtttacctgatcgctcttcagttttgaaccacagaattcattgattcagcttttgctaccctgcgtggctgcgtgctgttcatagttcctctttgcctgttacattcttgttcagtcctcactactcatccctacaattcttttgtactatccatgaaattcttttgtgtagatcgcacggcctataatcaatcaatcgtttgtttgtcacatccaacttatgatttttgaagctttctgtagtgtttcatactttattgcccccaattcttaggtgcacaaaattgaacacaagtcgttatgccttactgctataaagccacattcaattcatgaccaggtgattttacaaaaccaaactaaaatataacacaagctagtgttccttggtacaaataaataagaactaaacgaaatttcatcttctttgcagcatccagcaaagatgctaacttgtaaacttgctaagaatggaaatcattttttctggttgaccttgaaaccaaggagacgtccctacgatttagggcgctcgcgctcgccatgcacccaccattgccgtcgcgccgttcgccgaggcctcccctctcttaagtactcctctctctcttctcttcctccattgattccctcctccgcgcagctcgcggcttcgatcgatcgatcgaccgatctcccacgtcgccgccgttcgatcgatccgccgccgccgccgccgccggccggccgggcaagatgccgggggccgtgatcgtgcaccaccacacgcggtacaagacgtaccccggcgaggtcaccggcttcgtcttcttctgctgcctcatcgcctccgtcggcggctgcatcttcggctacgacatcggcctcaccggtacacgcaacctcaccggccgccgccgccgccgccgccattacatacgattcttcttggttgtggttgactgatcacgtccatggcagccgggttgacgtcgacggagtcgttcttggcgatgttcttcccggtgatcttcgagcagcagcaggagcgggtgatcacgaaccagtactgcaagttcgacagccaggtgctgacgctgttcggctcgtcgctcttcctctccgccatggtcgccggcatcttcgcctccccgatgtcccgcgccttcggccgcaagtggaccctcttcgtcgccgccgtcgcctacctcatcggcgccatcctcggcgccatctccttcaacttcatcgttctcctcaccggccgcctcctcctcggcgtcggcgtcggcgtctgcatccacgtacgttgtcatgtgacatcgatcacctgcataccataacactcattattatttgtatgtgaattaaataattatatttatttaaataaaacaataacataagttgaaatgatataaatctatagataagcatgtaagattaaatttaatctacaattagaaaaaaaaagagtaaaatcaaacagtgaatagtacattgtaattgtaatgtacaacccataaaaatttgttaattttattattgaattttaacttacatgtttctatagtgtcttatatcattataatctatcttatcaaactttttgaaaattttatataaccatttaaaccgcatgtatacagctaaggtgtagaaaatactcaaaattatatatcagttgttgatcgatcgccggtgattggcctgcaggcgtcaccgctgtacatatcggagatggcgccggcgcagcagcgggggatgctgaacatactgttccagctgatgatcacggtggggatcctgtcggcgagcctgacaacgtactggacgtcgaagatcgccggcgggtgggggtggcgcgtggggctggcgttcgggacggtgccggcggcggtgatcgcgctggggtcgctggccatcccggacacgccggtgtcgctcatcgcgcgcggcgagggcgaggcggcgcgcgcgacgctggccaagatccgcggcgtcgacgacgtgcgcgccgagttcgaggacctgacgacggcgagcgaggagagcaaggcggtggcgcacccgtggcgggagctcttcttcggcggcaggtacaagccgcagctcgcgttcgcggtgctcatccccttcttccagcagctcaccggcatcaacgtcatcatgttctacgcccccgtcctcttcaagaccgtcggcttccgccaggacgcctccctcgtctcctccgtcatcaccggcctcgtcaacgtcttctccaccttcgtcgccgtcatgaccgccgacaaggtcggccgccgcgccctcttcctccaaggtggcacccaaatgatcatctcccaggcaagcaagcaaccacccatttcatcaaacaccttgactgcaaaaccaaagatttaatttattcagcaagcactcacccatttcatcaaacaccttgtctgcaaaaccaaagatttaatttattaacaatcttgtttgatttctttgcagatcttggtgggaacattcatcggattacagttcggggtgagcgggacgggggcgatgtcggagcagtacgcgatgtgcatcgttctgttcgtgtgcgtgtacgtggccgggttcgcgtggtcgtgggggccgatggggtggctgatcccgagcgaggtgtacccgctggcggtgaggtcggcggcgcagagcgtgacggtggcggtgaacatgttcttcacggcgttcatcagccagatcttcctcaccctcctctgccacctccgcttcggcctcttctacttcttcggcgcctgggtcctcctcatgaccgtcttcatcgccaccctcctcccggagaccaagtgcgtgccgctcgaagaggtggcgcacgtctggaggaagcactggttctggcgcaagttcatcgtcgactcccccgaccgcggcggcgccgagatgaggaagaggatagccctagagatgagctagagttctctactaatatactgacgtgcaaagcttttacgcgttcgcgaaaaagagaagagaataaaagcttagctaacatgaacaatgttgattgattgatctatcatttcagttaagctaattgattaattgcctgattatgatagaagaatacacatactctcttcatcaaaaagctcatcatagtatttggataggacataatctataatgaatttggacaggcggcctatctagattatgttgtatctagatactaggttgggttttttttacagatggagtacttttcatagctaggggtgcagcatgggttcactcattgattagttggtaattaaacttgttgccgattctgatgttgtttgtactactggtatgtactctctctatcttaaaaaaaaaggcaaaccctgagtttccgtgtccagcatttggccgtccgtcttatttgaaaaaattatgaaaaaaataaaaaggtaagtcacgcataaagtattaatcatgttttatcatctaacaacaatgaaaatactaatcataaaaaaatttcatataagacggacagtcaaacattggacacggaaacttagggtttgtctttttttatttttttgacagagggagtaggactgatcatagcatgtcgttgtaagtgtaccattttgtttgttgttttccatgtaagtttgtcactttgatgtcagcttgttttaatttgtaaatgaagaattgatgacaagtttgttttccttggggctttggtccataaatcagtactctcaattgagcttgtccgcagtttattgatgacaagtttattttcccatggagaccttgtctggcccaattttctcagcccataatttctattggatgattaatttagctgtaagaataaagaatagatttaaattaaaaatatatataaataattacaaaaatgttgctttttcacactgcaatttttcccatggagaccttgtctggcccaattttctcagcccataatttctattggatgattaatttagctgtaagaataaagaatatatttaaattaaaaaaatatagaaataattacaaaaatgttgctttttcacactgcaaatattggacctaaattaattcgattttgctatatctcactcgaaagattttttcttatctctcactcgattttctcactcaaatttacagtgcattttcttgtaagttatagtgtaatttatgaaacttacaatgtaacttttataagttacactgtaatttttgaatcttcgcatgtaaattttaaattttgtattggatttggtctttttcttgaggatatggtaatttagtgtccattatagtgtttcttaattgctttttgcttttattatatctatcggattttaatccaaagattaaaaatatgtgtgatacgattataaaaatctttcgaaagatgtataggtactcccaaattaatttatttaagtatagtcaggccttttcttttcttttactttttttttggtgcttttcattgtttctgtgggctttggcctctcagagtaggagatggtgagatgagatattgcctccatgattcgttatgtagctgttcctgctatcacaaatcggcccaagcccaagatatttaccatccccgccttttcgcttttgcttagccccttttcccttttgcaagtaaaaatctgccacaaataacagggccgaaaaaatccgactgtaaaagaagaaaaaaaagggtttgcatatgctcgaggtataataaggagcacatatgtccatcgcaaacacaactgtgcgtaaatcagctcactggtaggcatgtttgtagctgatgcaggatgaattattataagtgaaactgagtttataataattatttcaagacatagctgagtaaattaaatatttaaccgtatacatttcttttcacaaaaattaccgatgaagaaagtttttacaaaaatcaacatatactctcttcattcagatttaggactagattcgtttattagatctagtattaggttcatttattttcattcagatttaggactagatttgtttattagatctagtattagattcgtttactttagaatggaggagtactaatgatgaaccctgagttcctctcgacactcaaggctgttgttggcccgatctttcggtgagttgatgaaaactacgatttggaagaaacgttgacgacccgactacaaccgtacaagacgttgcgttgcgccttagcgatcgatacacctctccgtgagttgttgatcttgccggtgcaaatcaaccttattcctacaagcaaatcgaagaaacaagcaagaacaagataaaagcaatctgaattgcaaataggagttaaatacgaatgataagttggggttccgaagaacaagcagacggacggtctatccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttagggcgcaccccacatgggccccacctgggccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatccatggtagccatggtcacatcaactaatgtaccgtttagaagcctagaatcgtccgtgtctgcggttatttgtgattctgtgaatcttagcaaccaaacaaaaattacccaaaattaaaagtggcagtcttacacgatctgatcattacttgccccaaactcaaggcaaaagtttacaaggtagtagtacatgattgatgatacataagttttgctccataaaaaaaggaccgattagaacgcatgtgattttcacgaggaaaaccacttgattcgtatgtacagaaaaacggtggaaacccctgtagactgacccggcaaacaagcatcatcagtgcatggatactggaccaaaaacaccataagaaattaaagagaacggagcaagcgagcaatcagccagctagtactagtacatatatattgtacagccgtgatctggtcggagatgagacgatgacccgccggcggcggccggccggcgcggcggaggcccatcgatcgatcacttgggcccccaaagcagcaggtgcatcaccttgtccgccttgccgccgccgtccgccgcgcgccgccccgccgttgccgccggcgtggccgcggccgcggccgcgcggggtacccgcagctgctggccggcgtcgcgcgccagcgcacgcagcgtcgccgggagctcccacctgctctcgcgcccgctgctcatggcgaatcaaccaccgctttctccttggcccttcttgctatgctatctagctcgtgctgctcatcctcagtccggtctcttctctctcccagccacctcacctagcctcttatactgccactgcactactcctggtcatgagtcacacacaattttacattttagccttttatgaacatttattttataaatagatctttaaaaaaaacttaatctttccatccagaaatataatatggtactgaatatgacacattccagcatcatgacgagtttggacagatatcttacaactaaaatatatccaatactaccttcattctaaaatgtagctatttctagcacagtactttgtcccaaaatgaagctatttttctacctaccttcccctctcaaccaatcacaaccattctttttcacctactttctcttttcaaccaatcacacaccttcttcaattattctcacatactttcttaatacccgtgctaacctcaaaaatacttacattttgggacggaggaagtatgatacaagattgctatatcatgtaacagatgaaatattctgtcaccgagctacaggtttgaatataacaatctaaagatgagatactagtactatatagttagaatagactcctttccgctctctcggagagactcatagctctagttctacatttttataatatgtaacgaagagattaagtccttggttagtttgggaaaaattttagatttggttggtatattggatatacggacacatatttaaagtatgaaacatagtttaataataaaacaaattacagatttcgtcagaaaactgcgagatgaattctttaagtctaattaattcatcattagcaaatatttactgtagcaccacattgtcaaatcatggcgcaattaggtttaaaagattcgtctcgtaatttacacgtaaactgtgtaattggttagtttttatccacatttaataattcatgcatatatctaaatattcaatgtgatgggtgaaattttttgttttgagagctaaaaagggcctaagttttttaaggatttatttataaaatatgttttcagaaaatggctagtgtgaaaagcccagtcctgagtcacctcctgcaaactgcaatcaacaggggcaataatagtcagcaataaatatcagccaccatgattgatgaacccctccaaaatcgagtggccgagagatacccaaagacgggatttttatcccgcacccaacgcctcggcgcgggatcaccacgcgcttggcgatcagtgcgtacagcgatcgcgatcgccggtgcgcgcgggggtgtataattttccacggcggcgaggggaggggaggggaggtcgtggatgcggcgaggcgggcggtcggtgtcgggaaaggggcgtggagtaatgcgcgtgtttgaaaaacggggtctctcgaccaatccggaatgaaccagtggttggatttgggctcgttcttccggtaaagggcatgttaagagaagtttttaaccagctgcaggttctctcggattctttagctatcccaaatagtccgcattattatttggattcagattctggtaatatataattgtaaaatctaaaaaaataaaatagaaactgtattaagctgaaaaaccaagtttcttcaggttataagaagctgactatcaaactaagctggctatcaaacagtagatttaagctccctgaacagggtttttgttgtggtagggtttttgttccattgtttgttatatgtcacataaatagttagaaaaataacaagttagattcatacaagatatatccgtttaaattcaacttctataagttataataaaaaaacacaaatataattgtgaatttacgttaactcgtttgaatttaatatgttcttttagttataacttgaagaagtgaaatttaaaattgcattttgtgagacgatatatcccatattaatttattttataatttttttcttaaatttttcagtgtccattttgatgagatacaataaacaagcagatgtttggagtaggggtggacattcggtctgaccgaaaatttcggtctcggtctttggtctttaaaaagtaaagatcaaatttcaatgcaaaaatatcaggaccgacaaattcagtctcggtctcggtcctgacccaaattcaacaacactttcatatacgcaaagaagcaatggaaattttcaatacaaaaatcacagaaaaaatgtaagcacttatgagtaaatactcttattaggttgtatgcctagaagaagtaggatgcgaaaaatagagtttaatcctattgaacatagtgattgtatgttacatttatacttttttttttgttaattcagtctttttggtctattcggtgagactaaccgaattgaccaaataaaattcggtttttcactttctaggattgaatttttcggtctcggtctttttggttcggtctttttctgaccaccgctacttggaggatgaaaatccatctcccgacacaagtcccagccaggacgcactaagcactggaaacagctgtgggagctggagtaccttgtagtctcgtcctttgctctatgcctgcggtgacaatgtgaggctatgagcagtaagctggtgtaaataattgagttagacaagtcaatagaaattagtagaattaagtagtaggagtaatggtatgtatgcttccggtcataaggatttaacttgtaagataaaggctaatcaaacttttcgtaagatcttgaccattagtattgccgtaaacctactatacttacaaactttttaaaacatataattgttgtttatagtgtttgacaaaatgtcatcctaaacgtcaaagcaacaacttgtttatttggttgacaaaacagtctaaatgcccttcaaaactttgaccgagggtgcatgtagcctcttttctggataaattaacaggatctgcttatatgtaggagagttcactggcctgttagagccaatgtgcttgagattgttgatgtgctccgtattgaagaagtggtttcggatggtccaaaatgtaacaaagaaaaacttatctaatccaaattaaaaagactgagtaaataatagttcaaaataaaattttaaaaataaaagatgatccaaagtgtaattcgctaaaaagaagaagaaatcaagaggagaagaagaaaagtacgtataagaaccgccaaacctggatgcatatcactaccattcaggtaataccgccttcctaacctatatgtgtgtaagtacgtacgtgcgtaaaagaaaagtagagaaacgctcaagggttttccgactagtttcacaaggtggtggactagacgacctagattcgaagccttacccattctaattatttgacattatgtccttccctaatattcgacctgagttcaaagcctcacatcttctaattatttgatattattaggtccttctataatattcgacctgggttcaaagcctcgctcattctaactatttaatattaggttcttccgtaatattcgtgatttttaaaaagaatagtacgttttgaagaagaagaagaagagagtagtacttaggaaccaccaacgatcccctcctattcgtccctagacttctctcctcttttttctctctatttatttttaaaaagtctcctctcctttttatggtgtagttggctcagcaataaccatagctgctaaactacaaatttaatttctaatttatttcaataattgtatttctcatgattaaatcaataatttaagattatgaaaaacagaaaatgaaccaacactatagctgtgtgtacatcatccaattagtctaaaaaattcaagataactttgccagagtagacggctaaattaccacaattcaggacacatgtatgttttgaaaaaaaatagcttgtagatctaataattagagaaattttataacttctaagggaaaaaaacaaatattaaccattggttttcacttaaaccggtggacctatagttaccactagattatgtatctaggaaacaaccggctaatcccaccttcttaatcccaatcctgtacgtaagtacatatttatgcgtgtaaaagaaaagtacatacttacgaagtactgccaaaccccattcccgtgcaattcgttccgtttgactcccctgctttctatacggcatagttggctagtcggctattttctcgagtaagtatcttcttgagtaggtaagaaatagccaactttgccatatagataggaagggagtcaaagcgagcgaattatttgcattggcacggactatggataaaggcgtcgcggggtacacaaggacgacgacgaacaaaaacggattgtgacgatcggaaaaaatgtgtatcattcaattttaagatgaattccaaactaaaattggtaacttgctaaagattcgatgtaaattatataatacaagaaaataatattatatgacttaactaggctagaaaaaaacttagtactctatacaacataattttatcgtggtattaacatattcgttatagtcatccatgtgagcggtttaatatatacaactaaaattgcctttccccattgcaacacacaaacttttttcctagtcttttttttattaatttagtaaaatttatctgaaaaatgactgcatattagtgttttgtatatatattagtgattttaaatgttgaggtttgatttatggtacgtctcagatatacacaatatcgtattaaagagagggatacgtgtgagattacatagctataaatacgatttggaccgttcacctacaaactactatacttccactatttgattgcatggctcgggataataaggttgaaggacaacaaattggcctgtgaaacaacagttaatttgagttaattaatcttagtatttttatttttaaaacgaaattaatctagattttttaacctataacatggctagctagtgaccagcgacaagcttgaacggagtatacaaccgcttagagcaggtacaatgctataagccacctataaacacatatcgagaagataaatgatgatagagaagatttttatcagtgaaatagtgaatgacgctatgattatacatgttaaaaaaatatgaattatcaacttcaaattaaaaaaaaagagcattgccgaaacataattaggatgtgagtcaaggatgaaaatgagttggattcggacaactaattgatgtatcatattctattccacagtatcttcatggagatttagacaaggcacagataatagaaggtgtgaatgtccgaaacattagttttttatatataagttttttgaaaaacaaattatctaatttcaagtttataataattaataattaattaatgatacgctaataatttgtctcgtttcaagtgttggctaagatcaaaccgatgtcccgaacgcagcttttagattctgaactcacgagagtctttaggttaaaagtcatgctgtggagctatagcctaaacaatatcgctaaatatcttttttttaaaaaataatatatcctacaaattctcaatcaccaagtatcctacaaaaaatcaaaatggttctacactgaaactgcatttttctacgtaccctcacataactgtggtaaaaacaaattgagaacataaaataccacacaatctacattcacaccatatgccctgatactttttgaactttgttttggaagcactctactactcgtctactgcaaaagataaagaaagaaaaacaaatatagcctagccacatatgctgaactcaactcacgttaaaaactaaaacatttgtctttttcgtttacctagattatgtttaaatataattcttggtggaatagtacatgatagtatatttacgtaaaactctattataatttttcacgattatctttactactttaacctctcctattatccataaaaaaagaaccggcacactcaaaggagtgaaaaatattattctacatcttattgtaacgtaaggatatggtattagtttacattagaccttattcgttcaatcaaaaaaaaataccgaggatgaaattttcacatcatatatgtgaaataaattctactttcttcattctaaaatgttgcaatatagaacgtgatttaatgataataaatctgaaacaggttacttcctccattctaaaatataataactttaaaaaacggaacacattataatactccatccgtcccaaaataagtgcagctatggttttccgcgtccaattttgatcgttcgtcttatttgaaaaaattttgaaaaaaaattaaaaacataagtcacgagcaaagtactattcatgttttatcatctcatagcaataaaaatgctaattataaaaaaaatttaaataagacggatgatcaaagttaagagtgaaaactcatgactgcacttattttgggacggaggtagtactagaggtcaccccgcgcgttgctggggaaatttaagcaattacaaatgtcaaaattttggatgaaatataatcaccttaaaaggaaaaacctaacccaatttatcactgcgcgtgaggaatatttgtacaaataaaaataatcttcaaccgtaccaagttcatagcctgcaaataatatttttcaaacgtatggcttcgatattggtaccattaattggagggaaactcaactggcactcccttccactcatattatacaaaacaaattaagggaataagtaacaacaaattgctaaaagaaatgttgatccgctggagcatgagcatatatatagcggcaaaataaacgcagcagcatggctaacggaatgaaggattgatcgcaacgatcaagtatagcaactggactctggacaggagggcttgtggtcagcatgtcaatccactgcgatggtgttttcagaggaatcaggaataaaggccgagtattcacctaattcatttagctagaggatggaatatatgcagtgcaagtgcagtggaagatggaaggcctgctgcgtgagccaatgaatgaatatccaacgttttggtttcaatcaggagatgacccgtcaggaacaaacggtttaactgttgaataggcccctttgttaattactgtcgtgcatgatgatcggaattaaaaaaaaaacgaagaggtgcatcccactatcgctctttacaccctcatttgcaatctagcggctaggtggaatctatctgcaatccaacggtcaggtggaatagaggtgatgtggatcactcctggagaaggaaattagttttaattgtagttagtgggatgacctatatagatatatatatatataggatactgttcttattcgcaatattaaaatatatttcaattatttaaaaattgtttatatttctggacagacgaaaacaaacaataatccccgtgtcctcgcagtgaggctcgcaccgcccagcatccttggaaacagagtgagcgtccaaaaccggcggcgacgcgctccccgtttcgccgctttccgctcatctcgcgtataaaaacatggcgtctcccctgaccaccacgcctccaccacctccgcatcactagcaagcgcaagcgccgcgcactgtgaccgagcggaggcggaggcggagtagccgggtcgggaactcgggatggcgatctgcggggcgaaggcggcggcgccgtcgctggtggtggcggcgagcatgggcgccgtcgaggcgctcaaggaccaggcgggcctctgccgctgggactacgccctccgctccctctacctccgcgccgccgcctcctcgcccaggctgcgttcccccctctccaacaccgccgccgccgccgcgcggccgccggcggaggaggccgccgacgtgaggctgcgcaaggtccaccacctcgtctgctggggccccaactgatttatattatatatactcatctcacatcttcctgaagaacatatgccactcgtctcgtcgtcttcctctgatctctgtgcagtgtagtgctcttctcttctcttttagctgtgttgcatctcgatcgatcgcttgcttgattgctccatcctccgtctctgtgatctgcatgttcagtttcgtgcagattcgacccgtttgtgaaaatgttctgccgcttacatgtatcttcatccttatgcatggagatctagctagcctcctattccctctgttccgaaaataaaatcaacttcgtacgagagtagactggagtccttgtagccctccattttctcatttactaattttggaaaaaaaaatcagtaccatcttgagatcttgagactggacttaaaaaaccaaattaaagagaaagagaatatgttagttaattgcatggatatatacatgcttgtattataagacatctgaaaaaatagttacgtcttatgtttatgttttgagatgaaaggagtactaatcaagtcaagagcgccttaatttcagttttgtcatgtctaattaccaaatcgagatgacagtatttgaagacaagaagggatgtgataaagctacaaacctgggacaagaacgcatcttgtgagagtgaagagagctaacttaccaaatgcatccctgcatccatcccctggttctcatatgaactttgtcgaatctacaatgagaattgaaaactaatagtactataagatttatggatatggatatggattgtgtgtgcatctgatgaactagcacaaactaattaatttcccctcagagagagcaaaggcgtgattgggtgcagtgctggtgaacctttgagccagtttcagactttcttgctaattaatttagccggccggcaggttcatcaacgctgcactcaataatgccttcccttctcttccatcacccatcgatctcatcatgaatctgccaatattcctagctctaaatctctaatcccaggaacaggatgcatcacttggctaggcagcttccatgcttgtgcgtgtgtagctgcatctgcactgcatttgtgtgtgtgtgtgttgcttttcagacaggtcacctcctccttttgtactactgcatctgcaccgtgcctaacggtgttgcttgtactaccatgggatgcagcagcatcctcggattgtactaatttctatgtgttgtactttgtcacgtcctgatcgatcaggtagtacgtactactaattcagagttcagactttagatgagctctctaaaattccacatacatgtaatacttgacagaaaaatgggatttttcttatgagtgcagcatttttcagaacaaaagaatcatgcatacgcttctctccaataattcagagttgtggagatgatttgaccaatacaacgatgaagttttaggcaggcagtacagcatgaccgtgaccgtcctgaacctgggcggacacggcaagtacagactatagagcagtacaactacaaactgtactgcattacaatttgcaagttcagaatatgagtgcctgtccttttctgattaaagatgattttatctcggtttctgttagcaagctttttaaactactaaacaatgtattttgtacgataactttccatatatacgttgttttaaaatatcaaatatattcatctgtcaaatttgtagtaattggaacttaactaatcatgcttccgttttacatgcgctaactaatctttatcaataatctctttgatagtgctagtagcctagtactaatactttgtcaagcagtgtcgcaaacgaacacgtaaaactatgaatacgatagtaggagtacagaataatgtggtactcgctgcattgaagtttcgggtttgtataggctaaacttcttcaaatttgaccacgatcacaaaatatatagtctcttctagaagacgttttgactttggtcaaagtcaaaccactttaactttgatcaagtttgtagagaaaagtagtactaatattttcaacccaagacaaatttattatgaaaaatatattcaattattgatttgatgaaactaatttagtattataaatattattatatttatatataaacttagttaaatttgaaatagtttgactttgaccaaagtcaaaacgttttataacctgaaacggagggagtactatatagcagcatctaaccacaccgaattagtttcatcaaatccacaattgaatacatttttattgtgtatttgttttgtgttgaaaatgctgctatatctttctataaagttatcaaactaaaaagtagttcgactccaaatttcaaattctatatagaagtttaataaaaggaaataaatctatttttcaaatttataatagttaatatttaattaatcatgtgccagtgagattattttgcttcgcgtgtagtacaaatcttcctcatccaggaggaattagctccaaagaccttcttttcttttcttcccacagaaaagttagctctacagatttcagaactgcggatttgcagtatacctcagtcttgggtccagtacacagaaatgataaataactacaactccaaatttgaatgtgcaaacatctcgctattgccaccagggcatggaagatgcagaattggtgagcttgtacttatctgttgagaatttacacgaatttcctttcaacaaataaaaacagccgtatgctaaagtaggcttctgaacaatatactagttttaaagtttcagattatctgtatactatggtccaaatacaaatcgtgcccattgtaatcaggatgtttcaagtacttacaaatagtcccaatatcagaacgaatccagaaggggaaaagaaaattctcaaacgttattattgacaattgatatctctggcatggaagtgtcagcagcacccagcacagccaaagaaagtaactaaaactaaaaaggctgctagttcatctaaaaaaaagactgcgagttgccctcaaaaagggggaaaaaggactgttagttgaaaggtaagttatagatggccagaagctaatggtgcatcatttgaacacctcacatagcaaagaaattccttttgatgcaccagaagatgatcctgtttcactgtttggcacatatatgaacatacactgtcacttagatcctaaaattatgcatgaatgataaacatgaagaattagactatgatgctgaatcctagtgagatttggtacccagaatttgcccagatatttgtttgtatgtgaagaggtcttgatgacaaaaggttaatcacattacaataattatctacttcctaggccgccttcgccatcaacaatctacaaatatggtatcggttgcatgcaaaaatttacatttggactggccaacatcgttggttacactgaaacaaactcctgtagtgcacagttgcttgactcatatatacatgttccaaaattgactcatatatactttgtatccttagtaaaaatggaatatacaattatcagaagaaatactgaaatgtaaagaagctagggaacaaaaaaattaagccaaatggtacgaaatggagaaactagaacagggtaaacctgaacaacgatccaatgtatgtgaacaagttgtgactctggcctctgatggaacaagctctgcagctgaagttgtattgtaaacctggtcgtggtatttgcaactggtcacatgttttacaggcggcaactgcgttggcagcctgtcctggcttttgtcggcaatgtagcggattaattagccctgtggctgctgtgatggtaaacgtgacggctgctgctctccttgcattccttgcatagattgctcaggttgctggtgctgacctccttgccatgcccaaactatatccttaagtgcaggccttatatcttccttcatgagcttttgatattctatagtgtccccattggactttttaaattcaactaaatggaaagatggagcaagctcaaaaacctcagcatcaagctcaagtaatccttttattccttcctttggtgctaccaacctcagaaccccattttcttttttcttaattttgagcttgaagcgtctggccaattcatttagcttagcaaatatagctgccgccggttgcctagtggtaaatctctcttccctccggccatatctttcttcaaacaaattggataagtcaaacccggtagacagagaaatgatgtcaaacgcgttcaagttcgggaggcttaatgaagcttgctttccatcggaattactacattctggtgagtcagaggttgtggcttcaccattagtgtacactttgtctcttgatgacgcacgatttccctcaaaaatactgcattctgttgtgtcagaggttgtggcttcacccttatacaccttgtctcctgtttcatgtttgctcttcagtgcatttacatcactggattttctgtaccaagcgcttctctttatcttcgggatagaaattctagtacttggatctggatcaagtatcttatatagcagatccttcaactcagcagaaaaggaacgagggcatttgtattcagctttggcaatctttctatacatctctataagatttgtgtcatggaaaggaaggtagccagatacaagcacaaacagaattactccacaagaccatatatcagccttcgcaccgtcgtagcctctcctactaagaacttcaggagcaacataagctggagttccacaggtggtatgaaggaggccatcatgtctcttggactcagaaagggcacttaaaccaaaatccgagacttttaagctctcattctcatctagaagtaggttttctggcttcaaatcacggtgataaacaccccggctgtggcagtagtctataccactgatcaactgatggaaataccgcctcgcaacatcttcactgaactttcccttggatattttcttgaaaagttcaccgcctttagcatactccaaaacaaagtaaattttgctcttgcttgccatcacctcaaaaagctgaagaatgtttggatgctttactaatctcattattgaaatctccctctttatctgcaccattagcccaacccttgttaccttctccttatcaatcatctttattgcaacggcctgtccgcttgtgagattccgagcataatataccttggcaaaatttccctgtcctaactgcctacctatttcatagcgatccatcaaaattgtcctcctgtcatccattgtagcaatctatttcaagaaaatcctctaggcactacttatagaacaatatatttcaaaagggagggcttataaatgactaaatgaacactatcaccaccaaggtcgtgtccatcaaagatataatgccacgatcttcagtggttcagagaccagggtacagaaaaaatcattataacagcatgcaggcactgctcttatttgaactcaaccggacagttggtgcaaagctttccggtgcactagcacacaattcggccttttcaaggacaaatatcttctagtgtcacctgttgaaaacaaaacggagaacgaacaaactgaatcagggcaaacatataatgtgaatgtagatccaatcatccaaaggtaaatcaaattgaaaacaataattcactgtaaatgcgcattcacattcccttttttttatacgcaaggagcgcatctttgtattaaagagtaaaattatttataggcacattcccaaagttaggatagcattacgaatttagtaaaaaaattgcaggattccccatttcactatgattttgaatacccaccaagcattccttgtaagaaacctaaaatcacaccaaacaaaacatactccaaaacgacaaaatgacaagtactacaaactaagcagtgattcatcctaaaaaggtagatcacacgacgattgatctagtgttctaggacttcaggctactccgataaaggaatcaacaaataaaaacctgcagaatccattcattcatcaatccccggtagcagagcaatccatcatactagggcgaacacccagctccccaaaccctacctcaccgggacacagagctacaaatccagccataaaccaatcaaactaacaagcaatttacccttctcaggccttagccgcagagatcacaaccacaaataacctaaccaaaccaagaaaccgcagggagcacaacatcagctgcagatctctttgcggccacatcaaaaacaaccaagcaatcaccaaggctgatactaccaacctgagatgaactggccgcggaggagaggcggggatcccgaatactcaggtgaagtctgctccaatccaagccggcgcagccacagcgcagccgccctgcgctttgacctatttgcaagcacagcctattaatattttaattaatttttaattacctttttttggttattttagtagaggagtggcatctccgctccgcgtcgcagccacatgctctgatgcctccagagcacagtccacgttcgcacggcagctcagctctaagcagcgcaacgcgtcatcacgccgcccggtgggccccacagccgccacgggcctggttggtgggccgtagcccacgtgggcccaccggcggcaaggtgggctttctcctcgtggcccaactggcggtggtgggcggcggatggcggaggctggcggcggcggcgtaacagaaggagaaggtggcggcggtgggtgcgggaggcggcggtggaaccggcggcgccccccaacggcggcgcacccacggcggcgtcggcggcgcaccccacggcggaccaacggcagttggcggcggcgatatgcacggcggcggcggcggcggaaatctcgctggggcggttaggattctaaccctaacccgccccctcccccacctttttgcctgccggccaaattgggccggcctagtactgttcggtggtgggctgaaacctatagtttcggcccaccacccaatttaccctttttttgttttaaatttttatttttagcagccattacactttagtccctatgttttatgcaatttaatagaaacagttcatcagttgttcacattattatgtaatggtcctatagatcactgatgttatgtgttaattaacatagatgtttattcaaataccccgtttcactaaatttatttgttgtcttaataacatgccttttgcatattatttcaagacacactctactttctcgcttcattaatttataaaattctataaattttgtactttgatttagcaaattctcttaattatgtgcaacatgattaatggaggatttaatgcatgttccacttcacattttgactcggaaattaatcacatgtagatggagtcctatactttggtcatcacgaccataatttaggcagcgagtatcttgctcatcatcaagtggtctacattttgagatgattacccgatggagccctacaaattggccgcactggttataacctaggcagcgagcatctcgctcatctcacagaggtttacatctcatgatgattacccacatgtgttattttccgagcatatgttttgaaaaatgagattatttgaaatttgattgaacacaaggtagtggagtcctaaacattggctgcggtatattcaccagaatatatttgcctggagaccatgttttaggcagcaagtataacttgcccactattaagagatctactccactgtttaattacttggagattatccacattgtgccacctaatttcaaatcctaactcaaattgtcaggtctataacctacatcttttcgaaacattacaagatatgaagttttacatttcgcattgagattacaacctcaatatcatgtttttattaatttacctctgtaaattaatagtgttaatcatgattatagggacacggcaactatagagttcaccgaactcgccctcgatgggagtaactacccaatttgggcttctgatatcaaaataaatttttcttctagtgggatttcacatacagattaagaacccaatgattgggatccaccagttgagaacagaaaactatatattacctttttccttctgaggttctatatctataaagatctcaaatatgagtacatgttggagacgagccctctcaacctatggaaagctctaatagagcgttatgatcagcaaaaggaactcatttggccagaggctaattatgagtggattcatttacgcctacaggattttaaactgtggccgaatacaatcatgttgtacataacatttgctccaagttgatattttgcgataagagccaacggaagcagagaagatagagaaaactctatcaactatgtttccagaggacaagatattgaaccaatagtatcgcactaaaaggatttaagggaaattcctcgaatacccctacgaatctgactggaaaacgcaaacgcaacaacaggcgcaaatccaatggtcgacagaaaggaaataggaagggtaaggcaccacaacctcgtggcaatagcaacatgcattgcaacaggtgtgtatctgactatcatgtcactaaagattgccgcatctcaaaaacatcttgttctcctgtatcagaaatccctaaaggagaaaaagtcttctgaggaactaagatttgaagctcacttcaatcttacaaaagaaagacctgaggttgaaagttctcactaggctcctattgaaccagagaacaccctcgttcttctcccagaggataccactgcgctttctgcaatagatgatatgctcatcgaatactgctcaacggacccacttagagatttattgtaatctcagtgcgtcccacttagagataaagctgctttaatctcagtgtgtttaagacattatattgatatcctatagtttgtcaaaacaatattggttgtaataagtagataagtacaaactcccttatattataaagttgtaagacttgatagtcattagagtatgtactattaacctatgtaaacgtcatactatgtatctgatgttttcattattgtatgtatgtatatattgtggataaagaattcttcactaagcaattcttctttcactatagatgtctaaggatatcgctctgaaattgtccttctctcatccattgtagcaatctatatcaagaaaatcctctaggcactacttatagaacaatatatttcaaaagggagagcttataaatgactaaatgaacactatcaccaccaaggtcgtgtccataaaagatataatgccccgatcttcagtggttcagaaaccagggtacagaaaaaaatcattataacagcatgcaggcactgctcttatttgaactcaacgggacagttggagcaaagctttccggtgcactagcacataatttggctttttcaaggacaaatatcttctagtgttacctgttgaaaacaaaacagaaaatgaacaaaccgaatcagggcaaacatataacgcaaatgtagatccaatcgtccaaaggtaacctaaattgaaaacaataattcactgtaaatgcgcattcacatttctttttttatatatgcaaggagcgtatctttatattaaggagtaataaaagttatttacaggcacattcccaaatttaggatagcattacgaatttagtaaaaaaaattcaggattccccatttcactatactttgaatacccaccaagcattcctggtaagaaacataaaatcacaccaaacaaaacatactccaaaatgacaaggactacgaaactaagcagtgattcatcccaagaaggtcgatcacacgacgattgatctggtgttctaggaatctaggctactcctataaaggaatcaacaaagaaaaacctgcagaatccattcatttatcaatccctggtagaacccgtcatactagggcgaacacccagctccccaaaccctacctcaccgtgacacagagctacaaatccagccataaaccaatcaaacaagcaaacaatttacccctattaggccttaaccgcagagatcatagccatgattaacctaaccaaaccaataaaccgcataagcaccgcatcagcagcggatctctttgcggccacatgaaaaacaaccaagcaatcaccaaggctaatactaccaacctgatcgagatgaactggccgcggaggagaggcggggatcccgaatactcaggtgaagtctgctccaatccaagccggcgtagccacagcgcagccgccctgggctttgacctctttgcaagcacagttctattagtattttaattattttttaattaccttttttgggttattttagtagaggagtggcatctccgctccgcgtcgcagccacattctctgatgcctccagagcacagtccacgttcgcatggcagctcagctcacagcagcgcaacgcgtcgtgccgcccggtgggccccaccgccgccacgggcctggttggtgggccgtagcccacgtgaggcccaccggcggcaaggtgggctttctcctcgtggcacaaaagtcagtgtgtggccgtggcgaggccggcggaggcagcggcggcggaggaggaggtcgtcgtcgccggcagctcagctcagctcacagcagcgcaacgtgtcatgccgcccggtgggccccgcccccgccacgagcctggtgggtgggccgtagcccacgtgggcccaattgacaaggtgggctttctcctcgtggcccacaagtcggtgtgcagcggcggcgaggctggcggcggcggaggaggaggtcgtcgccggcggccgcgcggtgacgggtgcagtgaagttcggcgcgaaacctcaagagcaccgcattttctacgctttttctttgtttttttttttggctcgagtgcgccttcgccgaacagataaaggccacgtcttttcttttgctttctcctctccaagcgaagccactgcttctactgcgtcgacttggaattttgccgaatctttttttcctatgcatttggcaagaccaagaaaacaaaaagaaaagagattattaatcatggcgacacgaatggaaatggttaataatcgcattgaaatctaaatccgatcctactaaagaattaattaaaaaataggagtactaataatgggcatagatagagggagacctcactctcagcataaaaaaattccatctttgcaggcagacgcaggtgcacttgcttcagtcaccacctcctcttctcctttgccgactcctgagccatcagtgtggcctaactcgtgtgactttcaaagtaagagtatctacgacttcgattcttttattgcctttctgattaatgaatagtggtaaacgaagcaataggatttgactcctggagaaggagaagctaagatagcactgagctctttctagatacacatccttctccgcggccatttcttggagcaaatctcattttgcacagccccaaagatttcttcatctttgaaggcaaaaaaaaagatggtcctttttcgagggaaataggggggaagatggctatgaagagagtggtgtttctgttgctgcttgtggcggcatctgcattggtgaagtcgtcaagaggaggaggaggaggggaggagaagttggggaagttctatggatggcggcgccatctttcttctggaccagctgcctcttcgttggttctcagtggggatctcgtaaggcgtccataaaccttctcctttgcatgctagatagaagtaatcgattcaatagctctagtttactttgcttgatttggacttgttatctgccaagaacttcgaatatgacttccattttgtcttcttgaaagtgaggcattcaggccttttttgttatttaccgttgttatgtttagtatatttcgttataacagaaatatgactgattgtttcttgatctttattgtgctcactttagtcaatcaggatgagcagtaaattttacttagttcatatatattatatgagaacaatttaacagatagcttgatgcattaacaaataatccttactgtgatgcaggtagacaaaatatggtcagtttgcttacaagacatagttagcccagaggatacatttggctttggggaatcatttgcctgggatgagttatcgagtcattccacggaagatgaactgaaggcaacactgttcatggaacttatggctcttcttccacctgagaaatcttcttttacttatgattgtatccgtgcaaactgcttcagcctgggtgttccacaaatattcagtgttgcactgagcaactatcttgagagccagaaatcattggtcggttcaaacttctatccgagacggcgtttggtagataaactgatcggagatgctccttccatggctccagctttcgcaccatccatgtcctctggcggtgaagttcactctcccctctctgtggcggaggcaccacttacaccttccaactctctgaacatggaacctcccagcccatattatcccagtaaatctgcacacaagcatcagggagtggcacctccagtttcaccttcagaggagtatcatgactacatgaaagtagtcttgatcgctgttcttccaacagccgcactctcattcctagctgcatttctatgtttctactgctgtggatgcaacaaaagcaaggtctcggttggcgagcaacgagatgaccatcctcttcttcacttgcagttctctaacttgcctggtgaggatacatcccttctatcaacatggtagattattattggtatggtagtatatcatctatcatttgaatggcaggttcgtcacctgatgtgcatgttcctgccagcccgcttcataaggatgatcatggggttaggccatccaatgctggtgtaagcatgagcaagtgctttccatgttgttttaaaacctcaagtgatgccacaacacctacactagtaactggaggaacacaggagaacaatgccacaagtgatgcccctaaactgatgcctccgccacccccacctcctccacctccacctccacctccccctccacctcctccgcgtccacctcctccgcctccacctatcaagaagggtgctccaccacctgcacctcctaaagccaccatggcaagatttcctaagctgtcacctacagagtcaagtcgttctgaagagtcatctgcaagcgagctggccagtgaatcgtctgaaactgaggtgaatgctccaagagccaagctccggcctttctattgggataaagttcttgctaatcctgatcagtcaatggcctggcatgacatcaaatttggttcttttcagtaagtttttaaatttagcaatggcatgtattctaagttcatttaggcttgcaactgacgactgcattctgcagtgtgaacgaggagatgatagaagaattgtttggttatggtgctggcaaccaaaacaatgtcaaggacaaggaaatttccattgcagatccttcacctcagcatgtttctcttcttgatgttaagaaatcatgcaatctggcagttgtttttaaggcaatgaatgtgagggcagaggaaattcatgatgctctggttgaaggtagttgaactattgcatatatttacatgcagcctacttacccatttgccaaaaaaaaaaaaagctcctaaagtttccattatcgctgtaaatacaatatgtttgcaccgccaaagataacattgcacttataaatgagccttttgaaaaaatggaatgctcgttgcattctatttaactgatacaagaattcgactgcaactatagcaagtttacttattaaactatatactgtgcatttctaagcacatgtatttgtggccatcctcttttagtttcttgtctgtctttgtgattgtggcccatctcatttcatatcaggcaatcacagtgaaaacatgtttcatattgtgtatgcattggtcatttactatatcatatgttctcttgttcactagatgtagctgttgaggtctaagtagtacacacaaagttgatgctgtgctggttcacttcaatatacttctgacattgtcttctgtcacattatgttatgaagggaatgaacttcctagattacttcttgagacaatcttgaggatgaaaccgactgatgaggaggaacagaaactcaggctttataatggggactgctcgcagctaggcctagcagaacaagtgatgaaggcactaattgatattccttttgctttcgagaggattagagctttgcttttcatgtcctctttgcaggaagatgcttcaagtctaagggaatcattcctccaattggaggtaatccatctgaaagtagttgacttctgtattaaatctgcgaagtattccaaccttttttctccaagtgttcagttttttatctgtttgtgccaggctgcttgcggtgaactcaagcaccgcctttttctgaaactactagaagccattctcaaaactggaaatcgtttgaatgatgggacgttccgtggtggtgctaacgcgttcaaacttgacactcttcttaagttatcagatgtcaagggagctgatgggaagaccacattgctgcactttgttgttcaagagatcattcgatctgaaggtgttcgcgaagcaagactcgccatggaaaatggaagaagtccaccatttcctagtacttcggatgacaattccaatgaatctctacaggaggatggcaattactactccaaccttggccttaagattgtatcagggcttagtaatgagctggacaatgtcaagagagtagcagcactggatgctgatgctttgtctacaagtgtggcaaatctgcgacacgaattattgagagccaaagaattcctgaactccgacatggcatcgctagaagagaacagtggattccaccgctcgttagaaagtttcatagaacatgcagagactgagaccaattttctcctgaaagaagacaagagattgaggatgttagtgaagagaacgattcgatatttccatggaaatgatgagaaagatgacggttttcgcctgttcgtcattgtaagagattttctggtgatgctagataaggcatgcaaggaggttggtgcttcacaaaagaaggcaacaaataaatctcaagccaatggcaactctaataacccatcatcccagtcaaatcctcaggagcaacagtttcctgctgttttggatcatcattttgatagctcagactctaatgattgaagatagatacaatcttagatactaagatacatacattatgttagatattttatattttttcgcccgagaccatgtaaaaagtcccatttgcagaggcattgttcatacataatcacattcacatagatagatttgaaacttcatacatgctattatgctataacattcagtatcaaatctgaagttctgaactcagcctatcgttagattctattttctttggtaagagtattcatatcccgacccctccccacatgtgtcatttcccagatatttttattttatttttaaagtcaaaccttttcttttcattttttgaaagccaaaacattttcaaccgtgtgatggaaaccaaaaccttcagcaccctaaagacgaaaaaataattagtaggatatggtatatttcagaaaactggatctattttatcaatctatcactttgctacaatgttatccacgtattttaaagaattgcaatattagtgtatggttttatcaaaaagaaagatacaacttaatttgtgtgacaagtttaagtccacatacactgtccattataaattgggtatatgtcatactagaaatgtggtcccgtgaccatggtaggtttttactcttttagtagctttatatagtccagttcttataatcatgtgtatagtgttgggcaaaactatatcccatcaggtagatgagtttgggtccattctatgagcacccgtcccgtctaccatgggtaaaaaacactcgtagatctagcgaaaaaaaattacagtggcctaagaccaaatcttagtatgaaatcatctcacctaaccacctatcaatcctaccaatattctccattgccacacaaaccgcaagtaaaaggcagtgctcgtggtggcggctagaaccactcatgactcattatgctcgtgagttgctatgcgaccaagacaagacaagggaggtagcggggctcatgcggttatagggggtagggaaaacgggattgaggagtcacactctcatcacatctctagtctccttcacatcagtctcttaccatttcccattccaatcggtggtggatccaggtacggaggaaatcttgtacccatgacaattgtgggtgttagagcaaaatgttttgacttgcataggtgtgtgcggggtattagaactggcgggtgtatttgctatatttagtcttacacacataggggataaattagtagttatatgataaattccgttgctaaagttacaattttatgaaaaatagccagctaaagttatacaaagtgatggtgtttgccaaagggagtatctaaagaattgccacaaattttttgagtcaaaaactttcagatataacaacttatataaaacttgcattcaactatggtttagttagctaatattgggatcttacgtgtgatatgtgtgaaattttttttccttcatgcacaaatcgtaggacgatccgatggtcacaaatttggaagttttgggagtagttattttagcaaatccgttaccaaataaggctgtgttcggaggagggggttgggaacccctcctcctcggcacgcaaaacaaagttcattttattgcatgatcaattaagtattaactatttttttaaatagattaatatgatttttttaaacaactttcatacataaagtttttatataaaccacaccgtttagcagtttgaaaagcatacgtacggaaaacaagagaggtgggttgggaaaatgggggaagaacacagcctaagcagttttgtgaaattttctcgataataggataagatcttctaggatgcacaatcctacccgtccatttccgatcggacggcaccggtgacacccaagagcaacccaggccgcctcctctcccccaaaacgcgcactcgtgtgctttcgccttccattctccaaaccctcgcgggagatcggaattccccaccccggagcgccggatccaccaccgatcgtcggcggcggcggcggaggaggctgcgacggcggaggcggagatgctgggccctcctcgccgcgggccggcgtacaagacgaagctgtgcgcgctgtggcagcgcggcaactgcaaccgcgacacctgcagcttcgcccacggccacggcgacatccgccgcccgccgtcctcccgcggcgccttcacgcaccacccgggtatggattgcccccctcccccctcgcgcgcccccctgttcgttgtttgtcttcgagatcccccgcccctgggtttagggtttctggtgtctagtgcaggaggcggagggcgttggatgtcctagaattttttattttatcgtcgtgattgtcgataagcttagattagatgtatgcgttgctagatggctagatgtgaaatggaagtgcggaaaccggactattggattatgtcaagagtagtattttcacaaaagccgagtgataatgttataagagtgagcattggaagtttggaactaagcggctggttctggagaacgtgacatactgggcggtaagcccgaatgcgatgtttggcttcccatgcaaaaaaggaatgtcataaaaagtggaaattgctggaatgttgccttttaagaggacattcgatacccatgaaggagttaggacttaggagagaatccagtcattgctgtaaaccttctttatgattcgcgcgatagtttgctggcttttttgtcttgttctattgcgtttgtgatttttactgtatttcttatacgagtgcttgaattcaaccaccagttgctgcagatagaaaataattctaacaagtggaagcttgttgcagaattaggtggcattcttactggttgtcttttgatttaattatcattcaaactagcagactctgcagatatgttgactcaactgctgccagaggatagcatgacctttttcataaattcttcacttggtatttcgacgatttgtgttgacgataatgcttgtgctgtaccagaaggtgaacttgtgaggatcttggatgatgcctccattgaatgattgccaataatatattcaatgtgatacaatcatgccattagctggctttgcaattactgggtcacacattatatgattatggtgcatcagctagttccattggaagtattattctcactggtgattcaaacattttgtgattcttcacaagtcgccattgaagatatctgagcaaatgctagtatatgtatgggatattgggactatgccattatggaagacctttcttcatcatacttgctatatgaggttatttatggagcactcatccatttcacttcagacgatcaacattattatattaatgggtgaatcagtggtttcttgtcgtatcttggtatatgcttgtgcattattttttggccctactttttttgtggctaatggcattatcctggagccccagctacttattgctaattgaataatcttgtagctcaatggtcttggtaagcttaacaggattatgggtgtcctactatctatatattacttcctttttgttttttgtttcataagttgcttcctttgtataaaacttgcacctccctgacttctagggagaagagattatagagccggtgatttcagaggcaggattgataggaggttttcacctcggaggaggcattcccctggaagagagtccaggggtcatcgtcccctttatgatagaaggccatcttctcgagaaagaggtaataactgctttctttctctgtcgtgtgtgtatttgcatgtgtgtatacaactgtttctggtcgcttctacatactgattgcttttaagtttatgctatttataaactcataaaaatgtgatttcttactgcagattctagctattcacgatctcctagcaggaagaggtacatatttcatttcatcatatgagcatgatcttttgaagttaaattctaaatatgctgtgagtgcatgttaaagccctgatcaaagttcaatttatggtgtctttgcttatctttatcatcgatttattagtatattgccttgtcgtgtttctattggtcttgcattttagtttttcatcattgttaatcaccatttgatatgcttgagttaagatccacacaagctacaattttagttctgtagttttatattaatggtgctgtaaactatcatcaacatatttgttccattataatgctaaaattatcttgctcagaatggtaaggttttgtattcttcctgcagattgtacctggtgatacttactatctatcactcaaattatttgttttgttttcatagtcataagcatgttttcctaaaggtcatgcaagcacttgtataagctgtattttgcgatcaaagtagaacttgatatttgaacactggcatttccgttggaattgtggttgggtttactagatttattctagatgccttgaacatgttgagtcgtgctgaactggtaatttacttttccacaatctatcctttatttccagtgagaggaggcatgaaaagaagactgacgatggagaaaccaactcatctaggagtttaagtctctctgataacaacgatgaaaagaaaaaggacaaattctcaagtggtgatgagaaagaagaccacgaaaagcaggtatgagaaaaatgtaatcaaattcatggcttatacaagcacatttggcacaatcttcattgcataattatgaatattgtgcagctgaaacaaatacggctggatatggaggctttgcgtgacgataaaactcagatggaggtcagtttctatttgtctcgctatatttgttacaatatggcacatgctaccatgttaacattttgactgccactttttattcactcataaaaaggagttggtggttgtgatgataggttccaccatcccatgccattttaaaagatcttttgtggatgaatctaccttagtgtgtgtgtgtgaattgtaggatcttttgtaaaggattacatcttctgcacatgtagacatgcataagatgatcgattgacgcaagtcatatattctattttaaatttgttactaatttgtcatatgtagacatgtatttttataaaaaagttcaaaactaatggcttatttatctgtggtatgctgcaatgaatgagcttatgagcactatgctagtaatgtgtaaattgagaaatggtaatgcatggatttcatcaagtgttcaaagcgtaggtgacttttcactagtccagtactgctgtgccaactatcaactaatagtgtttgcatgtagaacttagtatgtgggtattgtttatcatctttaatttcagacatattctccattctgttcatgtttggcacagagattgcacatcttccaatcatttaatagtagtcatgcttgacgaattggttggcagtgcgtctttccatgaataaccccaagagtaccctctagtcttgtgtccactttggaccttcattgacttattgtacttgagtttatttatttttgtcttcctgtcatgttatattttccgactgagctttggagcgggtcagcactcagcaggcacattattatatggtgcttgcgctcttgtttcaaatgctttctattttatggctgtgctaatatttcaaattttcaatggtgctgcaagaatttgatttcacattgtttttagcatctcgtgaacacagtacttgctaactactactttagaaaagactcctgcttttttttttgtttcatggaatgatattacaaaacatcctacttggccatgtctctcttttagacttttagaaaaagtcaagctcttagaaatgttacataaataaatgtacactaatttataaatggttccttataatttgaaaaaagtttgcattaaagacaccatttaataatattcctacttcatcactgttatgagcatgggccaggccgatgcagcagtttaggcacgataaattaggaataagtcatataatggtaggagattatctagttaggaaagagatgaagtttattatctagttgggattgatttctatgatactatagactatccttggatgtcaagcctgtcctccctatatataaagggaccccatgtactctatcattaatcaatcaatgaatctctaaagttagccctaatcctcagagcctcttttagctgagcagggagaagccttgccgctgctattagtgagcgagtgccctatcactgggtcttcggacccttaccctagctactccataacagtcactacccattgcttgtacttagttccattcacgtctataatgttagatcatgctgaatctttgctccaaactcttaactctagtcaacgcacttacctatttgtaggtcattttggatgagaagatagatgaagtgcgcaagatctctagcaaagttaatgatcttgaggtgcagcttagaagggagaaagatgaatgccataggtacttaagcaatgtttccacatgacaatggcacattatcttgacagtattatccaatagttctatattgtttttctatacctttgtaggatgacctcaaagatgaagaagtttattaaagctcatgctcggtttttgaaggcacaagaagaagtgaaaaggtgctttatgttttcatcatgtttggccttgtaatgctagtacacaccagattactcctttttgcataactatcaatcaataagtgttcaccaattggagttatgcaggtcacaagctcgtttcgagaggcttggtgatttgcttgcttcagatattttgaagcgtggtgctaatgaagaggggtccagtgtcaatgaagacctaaacgaaaggagtcctaatactgcagcaactaaaaagagatcaatcccatactcaacaagtgaagaagcgaaagctggtatgtagcttagtttctcgggacactctgattgccaggttgtgatttgtacaatatggatcttggtgttatgcagcatccaactttccccttctgttaaactgatatatgtacctctttatggagtaaccagtcgatcctagtatgaagtagttcaaatgttcctttatttaatattaagcattaaaattgatgtgcttagttttcttacagtagcactgaaggatgcctagtttcttttataattggattttaattctttctgcaaattgctgaagaagtgtcttaattatgtacttaaacctaattgcttgtctcctcagtgaagaagagaagagagcgagactctgatacaatgactaggtcagataaatataggtcagatgttacagattttgataaaacaagtaaggggactgaggcaaccaagtctttatatttgaagaagaaattatgggaagatgaaaaaagtaagctaggagccaacattttcacagaaaaggtgcaccatttctcccgcccgctctcaattttatgatgaactacatatcatacttagtacactcagtccagtgctttgtttaaacattatcacatattgctagcctatgcatttgattgcactgtatatatctctactagtgtaaaagcagagttgtccttccttcccctcttcccacctaccgcgtacagcgagagagtgaaaaaccgaaaggccaaacttattacttgtctaaacaaaaagcctagttgatatttggaaagttcggtcattgccagaccttgtattgaaactgataggcttccttgatcatcaggtcctaaagcccttcttggctatgttggcatctgtatttatctttgtttgattgtgcttatcacaggcaaatattttgttaacttgcaggtcaaaggttctcccgtcagacatgttttgccctccactggcatggctgctcatgctattgatgatctcaacgaagctattgaactggaggacagacatgaatccatagacgcattactagaaaatgatgctgatgacaaaactagatcacctgctattcccctgcagccaccaccagtggtacagaatgcttatgagcaggtgattaaattttcacctttccaaaaaaaaatattggacctgcttacatgcacggtcagcggcatggaactggacagtgcattttgtttataaaaaatcgttgtactaaaaaagctccttttttttccctgtgcatttgctaatttgctgaaaaagcaaactcataatttgtttcatcttttcccagtatgagggtgatgacgaggaagtcgatgtggaataagtggatggcctcgtttctagacaagaggcctctgatgaagcaatggcgagattagcatcttccccagctccttataattagtactattagcatcttggtgtacaaagtgctatctatttgacattgggaattcagcttatatttatcaagaatccttttgtagtaacatccttggcgctgagacagccttagtcaactatgtggagcagccgtataaatactccatagagtgtctggtttggctaagctaatgacgtatggtatgtgcgctccttctgccctggggattgcgacgccagatgtgtctaccttctttatcgctgcattcagttaagaagaagaaatgccaaagatgaacatttcatggtcatctggctagtcgagctgagcgtgtaaactgggtaaagcaagatatcctgaattgaattcctgatgcctttgtacagcctccccaagacccgaaaaagctagggtttgctgctggcctggtgctgcggagcgggcatgagcgccagctttctccctcgctgttaagggtgtaataaggggttaatttgtgaacccgcttataaatcaaaatcttctcatggctggtcgtcctcgctctcctgtcgtcggcttctcctccatcgccgatgatcatcactctatcatcagctctatcgtcaattcgtctcctgtgtttcggcctggccagattaacctaagcagaaagagcagtagttttatcagttggttatattgacccaagccagaaatagcagtagttttatcggttggttttataagtcgtaacaatatgtatctcacgacttaaaaaaataatatataaaaatatcatgttggaaatatcctaaaattaactttataatttaaaatcgactcaaatatctaaattttaagtttatcatacccgggaggttatcctcgtcgagagaaaccgacccggttgattttcctgtgtctatatatatcgaccgagttgaagcctcaagaggaggaaaggatcgaccccgacccgacccgaagtcccgaccccaaccagagagaggcgcgcgcgtgcgggtgcggtgcggtgcggatcggatcggattgggccgagtccccgaccccacaccacacaccccctcctctccccgtccgcgagggctccggcctctcctccctcccgcgatccccttcccctccgcctctcgccgccgcgccgcgcctcgccgcgcctccagccatcgccgtcgaccgcgcgcgcgcgcgagaggttcgtctccgtcctcctccatcccatctctctccccttccatggatatttccttcctcttctctcgggtttcttctcttctacttgatgagattttgtatgcatgtatgtatgtgtgtgcgtggggggattggattgattggatttggagcgcgccttagaaattcgaggggtttcctgcgctctgtttgctttgctccctagatttgccactccgatttcaaactcttcgagtaccaaccaacccttgcggtatttttgctcttcgaatgaggttatgagatctcatgagccacttagttttcagacatgcagatgcgcgcatgtcgcctccatgttgccggcgtaccatctgttttttttttcttctgttatttttttcgtttcataagattaccatgtgctagtaattactgtgagtgattttatcagagacccactaattttttatgccttaatttgttttctctcattttttgcagagcggctgtacgcgattcacatgtgcggtaatttacctgcctactgccgccaaccagaagtggaatataccctatcctaattttctttcttcggatgaaaggtctgccagtctgcgtcagctatggcacagagttcgtcccggcttcaccgcctgctcacattgctagacagtatcctttctgcaagactatggttcgctatgcttgcagttttacagatgatcacacgctatgctaggttatactctgtaccgattctctgataaactaagcaaattgcctcatgaaatgtgcaaattagctgggctaaaacgtacagtctatgcttttgcagtcgaacatatatcatttgatatcccctttggtttatctatctattgtgcaaagtttcctttaacacaactagctggttccacgcaagcgacaaggttcgctgctgcacggcaaattggagaaattgccaagtcccacccccaggagctaaatgtcttactcaaaaaggtataccaacaattccaccacctgctagttttgtggatccttctacctgaaaatgtttgcttaatataatatgtgtaagctatgatgtgtgatgtgcgaaatgcccaacttttagtttcttcaattcatgcttcgcttgcttggtagcacaaaaatgaaccctgcagttttatgttatgctgaattttcagtggtgttgaagttatagattttccttttctcggacatgcaggatatctgcattatcattatattaagaaggaaaagggtaaaagaaccctgattacaaaacacccacacaccccagctctcaggctacatgcctgtccgtgctaacaaggaccacacgcagaaaagaaaacagcgaccaaaactgcccctcttcaacctgaaactaaacacgaggctgtagacagttaagaaggatagccctctagcctcagccaaacaccaaaaccgcccctcctcttcagcaagcaggatggcactagccaagtttggagcagcactattgagggcacatcggtttcgatgcttccaaagcgtccaagcaccaagaatgactagagaattaaggccctgttgcactggaccgttggttgcctcgttggtcctgttccaccaaaataccctgaccaaagcgctgtcggagtgagaaccaaaatttcctcgcgaagacacaactagtgagtagatagatgattatttcatcagcttggtcgcaatgagggcgttgaagttatagattaaatatcaaactttgagggatatatgattttgtgtgatgtctgttgtaagatgcaatgccctcccatgcattgattgatggatgtttgttctatgagaagtaactattactgccttcattatctattatatcaaggtagtaacatgctcatccactggagaacaagcttgttttctttttacacatgttctgcggagaatggctggctgatatttatgcttttatgttatggttttaggtttctccatatttacgtagtaagaattgggacacaagggtcgcagcagcccatgcgattggtgccatagcagagaacgtcaaacacacatcggtgaaagacttgttcgcatctgcagaagcagaaaaacatgcttctgggttgtctggaattggtgatgttgggtcaacgttgcggcatgctgatactactgcaacatctgagcttgcttttggaaggtttgttgagaattctttgaaactttcctagtgcttagtagaccttcccgctcttcttttttgcctaattggaaatggacaaactaattccgtttaacttctttttacagcttcgatataaacagggtgttggaatttggatctcctttattggcatcaggtggacaggtgtattttcttcttaccattattttgccttgtcatatttaatgaatacaattaaaatactgtggtttttttttcagggcaatgttattttcagattcaatccatttttttcttttctgatagtgtcatgcatccatctattgtttgtttttctttgccatatgtcaacttcttgagggctttctatttttcttactaggaacatagtgaatcgaaagcacttgacacttagaagtaaaatagatcaagcctcttccattgcactgaattttcgtttttgacataaaactgcattgaatattgtaatgtataggttacttactttgctgctaactcgaggaaaagaattttagtggataatgtttaaatctaggaacatattctgaagctcctcaatataattatttctcaaattctggagatacacacaaaataacctcgaatttctttgtctataccaagatttttttaaaatttttgttttaaggtgtacttggcaattccattccatttcttatttgtttatggtttcatggtatgcaacatgtgaaagctaatggggattattgcttttgtgcttgctactaggaatatgacattgcaaatgataacggcaaaaatccagcagagcgtttagctcgccaaaagcaaaatctccggcgtcgtttaggttatacttctctcttacatcttattgttgctactttttaattttcactttatggcactcaccgcaccactgccacaaggttctttctatagtgaagactgcacctgtattctgcaaagtatcgttgtactctgatatatctttgaactttttgttgttgtgttggatttctcattcctttcatgtttctgttctagtgcaggtctggatgtatgtgagcagttcatggatttcaatgatgttatcaaagacgaggaccttcttgcccaaaagaattattggggtgcaaatatgcaaaacaatggattctattcatttaatactggtcagaatattcagcacttggttgcatctatggttcccaggtatcccaaacattccaattttcgctccaggcgattaagcgccagggagctcaatatgctgaagcgtaaagcaaaaagcaatgcaaaagatcatacaaaggctgtacccgaggatgatgacgttgtgccaaaaagttctggaccgtctaacggggcctcttctgatcaagttggttcacacaacacatgttctgtcaattgtactatatttttctaagattttagtatcctcccgcacaattttttatttttctggggtcatttatgagatggtcattaattccacattcttaaattatcgggagccttggtagaggttgtaaaactttgtttctgattgttctcaattgctagcacaaactatcatgtctgaatatgtggcgcagtgcaagtaagttaagtgcatttgtgggtgtgtgttcttccatgcatcatgcatgtgtggtttgttgacttgttattgttggcattcctgtttggcaatttacgcagttgcactggagcattctgttgggatggctttgtcttcaatctgtgatgatctaatcaccccacttacattttttcaggatacagttgatgcaatcacagatgaggacaatctggagtacagtgagaatgggagatggccttttcaacagtttgtagatcaacttattcatgacatgtttgaccctagtaagttcattatctgtcttgtctctgaaatttgtcccattcttatctcgcttacaatctttttactgagtgttgtattgtagtttgggaagttcgccatggcaccattatggctttgagggaaattttgacgcatcaaggtgcttgtgctggagtatattttcctgatctgaactcacctttcgctgaccttgatgataaaaacaatttggactccctgaaaagagcacatggtattgatcttaatgaagacattgattcgggacagctcgagccagttttgaaaagacaaaagaaagaggagtctaatccagaggttatggacattcagttggataaggagccaagtaacggtgattattccaaaacagaggcaagtctgagtactgagcctactgtatctagtggtgaaccaaatcttgctcatgcaaaggttgaatcacccttccaggttgatggttcagctaacccatctaaggtggatccatattgtacaccacctcacgaaacactcaactccatgcccaaactgagttctacccatctccctgaaaattcaaaatttataaagctgatgaaactagcgaactactcagcggtaaaaaattgggaatttcttcaagactgtgcaattcgtttcctttgtgtactttcattggaccggtatgtatctctggacttatatactttttgtgtgtatttggttgtcttggctattagtcttattatttttttttgcctttgttcttcctgtagctttggtgattatgtatctgatcaagtggttgctcctgttcgtgaaacttgtgctcaagctcttggtgcagttctgaagtacatgcatccgactctagtatgccatacactgaatattttgctgcaaatgcaggtgtgtcctgtagtaattatttgtcttgctgttgtcaacttcaaaacagtacattctctgttgtcatcatcatcaccatttccgtccttttctttgttctttcagcgcaggcaggagtgggaagttcgtcatgggagtctccttggaattaagtatttagttgctgttcgtcaggtgattgctaatgagaaaaactataacctaataggctaattcaatcgtctttgtgcatatatgaccagaggggcagtagtagttggcttgctaccaagtcaagttttgcttttcatatctctacactagaggaacttaggagttctgagaaacatcctcttctgtttactaatatttgtttttgacgcctaatttatgtgtaaaattgctataatattgtttccttccccaccaggaaatgcttaaagacttgcttaattatgttcttcatgcctgtaaagctggtctggaggatccagatgatgatgtccgggctgtggctgcagaggctctgatcccagctgctgcttctttagttagactaaatgatcaaatgctacattcaattgtgatgttgctttgggatatattgcttgaccttgatgatctaagcccttctacaagcaggtatgttcaatcatgctttcctcatttagtaaacacattgtttgcgtaatgttgaacactgagcccatgttatacattatatggtccatctacttccgatttctaatcttattttgaatccagtcacctgttcccagataaggaatttaaaatgttggatagttgttcgttgctcttttattccgtttaaagttgactgtactcatgccacaataaatattctgtatttctcatgtccaaatttcatttttgtttcagtgtgatgaatttgttagctgagatatattctcaaccagagatggttccaaagatgcttggcacaacagccataggtggagacaacgaatttgatctaaacagtgtaactctggttgccggtgaagaaaaaatgggttctaatgataatccttatgtcttagccgctctgacaccccgattgtggccttttatgagacatagtattacatcagtccggcgttctgctgtacgaacattggtaagaattacatggaatttgagatccactgtagtttgattgtgctgcagtatcaggtgcccattcgagttgagtatgagttatataaatgagaaacagaattgtaatgaaaaatatctgcaataatttaccgggtgaaatagcagttttgagccatcttgtgtatgttttctacattgttttgccaagaaaaaccaacctatccttgggattttgccaatctggagttggatattccactctgttcccatgtgcaattggtttttgctgtaagcttctgaatgccatttgttatgctttcctagttaaaaaccgtgaagttcaaactttttgtaggagaggcttctcgaggttgggaacaccaggaattcagctaaactatggcttgcatctatattaggtgatgcgctgcaagttgtcttccagaatcttcttttggagtcaaatgatgagattattcgatcttctgaaagggcttggaaacttttacttcaggttactgatgttctggctttccgggtgttgtgaatttactcaattcatagaaatttaatgatcatgtctattacaggattatagtaacaaacaaaaatatttctatgcttgtagtgccctacggaggaccttgagtctgctgcaagttcatattttagtaattgggtgcaacttgccactactccatatggcacagcattggattctgcaaaaatgtttttgccagttgcacttccacgaggaagtcgttcaagagctgctgcaaagatcaaatctgcaaggttagaacatgaaaatacgagaatgatatcttttggttctaccggagagaacacttcacaggaaaagcattctgaagcttccttgagtgtttcaaaaataattgtggggtctgattcggacaaatctgttactcatacgcgagtgctgacgtcaatggcccttggtctgtttgcctctaagttgccagaggggtcgtggcaagttgttcttggtccactagcaagcgatctcatgtctctctcaggagtccagagacaggtaagaaaaaaccttatgttttagtgcataaaagcattcaattcaactacttgttttgcactcataattttctatcgctccaggtggcttctatggttattgtttcttggtttaaagacctcagaaaaagtgatcctgctgcggtgggtacattgctagctttcttatcctccctgaaagggtggatgttggacttactggcttgctctgacccttcatttcctacaaaagattctccgcttccatatgctgagcttgcaagaacatacaggaagatgcgcaatgaagccaataatttgttccagtcaatagaatcttgtgctcttcttaaagagtatacaagcaacttaaactttgaagctgacatgctgagtgttgatgatgctattaacttcacttcaaagcttttgttaccatctgaacctgattttagtttggacagtgataaaattgtcttgaacaatatagagtcagcaaaacaaggtctattgtctacgtcaggctacttgaaatgtgttcaggtatgtgaaatttctaattagggtgtcttcagatttatattaatgtgttagaattacttgttgcatctgtctagttctgattttttttatcctttttattagcaatatcataaaataggtttccttgtttgatgatgttctgcagaataatttgcatgtgacagtttcctctttagtggcctctgctgtagtctggatggcagggctgcctagtaagttgaacccagtcattttgcctttaatggctgctgtaaaaagggaacaggtacgacatagtattcttatgctcttaaattttgtcttagatgtaagctcaaatggttccatatcatttaggaggaaatacttcaggacaaagctgcagatgcacttgctgagctcatttttagttgtgttggccgcaaacctggcccaaacgacaaactaacaaagaacctctgcacgttaacatgcactgatgcaagtgagacacctcaagctgcagttataaactcaattcaggttattgaggaccaaaacttgctgtcgattggtaagcgttttagcaatcacaaatccaggggccagatgacttccggtggtgaatcgaagtcggagggttttataagccggcgtggatcggagttggcttttaagcatctttgtgagaaatttggagcatccttatttgaaaagcttcccaagttatgggattgccttacggagtttcttaaacccgtcaagactggagatgatcttatgaaagaagatccaagtattgcgcagttaggaagatcttgtgaggacaaggaaccgcagtcccttataaataatatccaggtttgttttataaattaatttgaattcaattggttcccttttgttttggcataaaactgctacatgatgttggattagaccatcatgtcatatcaatatgaatcaatatatctttggttacttgctactatttagtataaactggtttggttccattttcatctcttgccatatttctaatgccatttctgctcctcctcacaggttgttcgttcggttacacctcatttggctgagcccttgaggcctcaattgctaagtctccttccctgtattcttggttgtgtgcgccatcctcatgtcgctgtcaggttagctgctgcaaggtgcatcacatcaatggcaaaatcattgactgctaatgtaatggtaattgtgatagaaaatgtcataccgatgttgtcagattcatcttctgtctgtgcaaggcaaggagctgggatgcttttgagccttcttgttcagggtttggctgtggagttggttccttatgctcctttccttgttgttcctcttctaaggtgtatgagtgatcctgatggttctgttagacagactgtaactcacagttttgctgctctggttcctttgttgccattagcaaaaggttctttgttaccggatggactgagtgaacgcttatctagcagtgcagaagatgcgcagtttctagagcagctcctcgacaactcccaaattgatgattacaagctcagcattgatctcagtgttgaactgcgaaggtctgtaactatcttaaaagctcctttattggaatgtggcttgacgacgttattctacttagtttgagatagtgtattgagtgctattgtggataccatacataataatacttgttataatgattattatttgatgttcttttaacaaaatgttgtggatcgctacaggtaccagcaagaaggaattaactggctagcattccttagacggttcaagttacatggaattttatgtgatgacatgggtcttggcaaaacactccaggcgtctgctattgtagcagctgatattgctgagtcacgtgcacggaatgatgagcaagatccgaaatctttgattatctgcccttctacattagtagcacactgggaatatgaaatagagaagtacatagacagctctatcatgaaacctcttcagtacatcggttcatcacaagataggattatcctccgttctcagtttgataagttcaacgtaatcataacgtcatatgatattatacgcaaggatattgattttcttgagaatgtcttttggaactattgtgtgctggatgaggggcacataataaagaactcaagatctaaaataacatctgctgtgaaacaattgaaagcacaacaccgtcttatcctcagcggtactccaattcaggtaaaatttcattcatgaatcttgttggtatgcttttcgtctagctgttgcggttcgctttacattgcactttttatttcattgttcatgttctttgtagataattccatcgatccagtactgaaattggtattactatttatttgacacattccactataattgcagaataatgtattggagctctggtctctatttgactttcttatgcctggatttcttgggacagaaaaacaggtaaatgtgctatgaattcaactttacttacagaactgaaagctaagaatttggtcgttgacatgaaccatgccttttttgttcaagaacttagtttagtttttaacatgttcctgatttactcttacgctagcttccaagcttattagttagttcaggaataatatatggatctatggacttgctagttagttccaagcttattattagttagtttagtttttttgttattcactgtggacttgctcagagcgacaggtgatatatggatctgccttatctgggccgttacactttcttacatatgatgcttgcaaatgatatctatgtttagttgtgttataggtgctaggctgcttgataaatcattagtagtttgatgacatgcatctgtagaaaaagacattggtgactatattgtattaatgtaagtggacatatatggctgtgttcggatgagggggttcccaaccccctctccctcgcattccgtgcgcacgcttttcaaactactaaacggtgtgttttttgcgaaaagtttatatacgaaagttgtttaaaaaaaatcaaattgatccatttttgaaaaaaaatagctaatacttaattaatcacgtgctaatggactgctctgttttccgtgcggggagatgggttcccaaccccacattacaaacacacccatagaatgttttaaccaaccaaagatgaaattgtttctgctttcatgaaggggtggatttttactagtcctgactcttgataattaccttggtctattctgatatgaagtatttgtgctgaaattaaatacaatgttaattatgcagttccaagctacatatggaaaaccattgctagcagcaaaagatccaaaatgttcagcaaaggatgctgaagctggcattcttgctatggaggcactgcataaacaggtttttatcttctgtagtagacttgaagtctttaaaaataactgggggttttgagtcttgtgacctttgttgacaagtaaaagtcattttgctatactaggtcatgccgtttctacttagaagaacaaaggatgaagttttatctgatcttcctgagaagattatccaggatagatattgcaatctcagtctattgcagctcaaactttatgacaaattctccaactccaatgccaaacaagagatttccactatagtaaaagaaaatgaattagatcaatccacttctcaaccaaaggcaactcgtcatgtgtttcaggtactgcagttagacaaacattttagctttctcattctgcatttcttatgtggtatcgtgtttgcgttttaattgaatatgcttttgtaatgcaggcactgcaatatctattaaaactttgtagccatcctttacttgtaactggggaaagcccacctgattatcttgtggaccttctaaaggaaatcggtatgggaactggtgatgagcttcatgacctacaccattcccctaaacttgttgctctccaagagatacttcaggagtgtggtatagggtcagaaatatcaagccctgatgcttctgcagctattgggcaacacagagttttgatttttgctcaacacaaggtactgagtctgttctcttattgagactatgtatccctgtttcttttggtatattttcatccttgtcatgtttataaacattcttttctccaggctttgcttgacattattgagaaggacctgtttcaatcccatatgagaaggtgagttttatatattgtgatgtacatcagcttcatgaagaattcatcatgccagtgtgttgtctgtgttgcaacagatttgaaaaaaatatatcatgagttctaaactgaaaaattatatatatatatttatatattttgaaaaatcatataatattcaatcaaacatcaatcaacaaaaaactcaatccatatgcacaaaagacatttatccggtcctagaagatacggtgagatcgcagtttcaccaccaccaccagtagcagattcttttatatagtagagattaatattagctgatgcaaattattttaagcatcttgctttatgttgttttatcttgtgttttattatgcttggatatttgtactttctagagtactgcagtgctgttttatctttgagtaactgtaaatataaggttgtcgttggcctagttgataactgactaaaaatacacacttctgtttctcagtttcctgcctgtgctcatctaatcagcaaacttttgatattcattcagcgttacatatttacggttggacggctctgttgaaccagagaagcgatttgaaattgtgaaggcattcaactcagatccaaccattgatgtgctcctattaacaactcatggtaggtttggagaatgccatatggatcagggatttactcctagatatatatactagaaaagctatatctgattctttcctgttgcagtcggtgggcttggattgaatttgacatctgctgacacattggtctttatggaacatgattggaacccaatgaaggatcttcaggtttgcttttgcatattttatcaacgataaggctaccattaaatttcctccaccattttcaagctatcctctgtgaaacaaacgaacaatactcccctcttacaggcaatggacagagcacaccgtctgggtcaaaggaaagtggtaaacgtgcaccgtctcatcatgcgcggtaccctggaagagaaggtgatgagtcttcaaaggttcaaggtgtcggtggccaatgcggtcatcaatgctgagaacgccagcctgaagacaatgaacactgaccaactgcttgatctgtttgcttcgacgcctgcttccagaaaagtaaatcccttgtgaccatatatctcgtatagaaaaaacttttgtaatttttattctttatttgggtttatgatcctttgtctatggccatacgcaggcgtctgtactcccaagcagttcgggtggtgatcagagtaaagattccaaggggaaatctggtgggaagggtttgaagtccattctgaatggtctggacgagctatgggatcagtctcagtatgcagacgagtacgatctcaaccagttcttggcgaagctcaacggctgaacacacgatcaccggtcctgtacagtgtaaagcgaattggggcgtgtgatgaacaggttggcagattttgttggcaaccacaggagtcagaaatttttttgttgtttcatacggaagaagggaaaaaaaaaggaagatcgcaagatctagagcaatgtggctaacatataggtgcttgagatggtgatctcaaatttttgtcttttgagcttttggttaggagggtttagagagagatagagctagtcttgagaggagttgtatatactatctgctcattataataattaatcaaaggctgcagctccttgtaaattttgccttgagttgcttactgtttctaccttttacttggcctagtaactgagctatccagtggtgtagtaagcctgcctactgggaacgcggatcatttttgtctcgctaacatgtgaaagtaatagtaagatcgggtaaaaacggaaaaggggtgatacattcttgcctatcaatccttgctcgtctgaatcccgttttggccgctaaggaagttcccaaaaatttttcctgttcattgtctgaatcccgttttggccgctaaggccgttttggacaaatgtatagagcacaaaatatatattaaaaaaactaattgtacagttatggagaaatcgtgagcttaatcagttcatgattagccataagtaatacagtaacccacatatactaatgacgggttaattacttaatttggctcaaaagattcgtctcgcggtttccaagcgagtcatgaaattatttttttcattcgtgtccgaaaaccccttccaatatttagtcaaacatctgatgtgatacctaatttttttttcgtgaactaaacggtccctaaaaggaagtcatctcagccaatgtgaaactgatgacctttcattcccttctattctttcatcgttgtaattgtgacatgttagactataactttcatcagttagaaattgatcccttggtctccctttattattattttttgttcgacccttgcttaggccatgtttagtttcaaaggttttcttcaaacttttaacttttccatcacatcagaactttcctacacacataaactttcaacttttccattacatcgttccaatttcaaccaaacttctaattttgatgtgaactaaacacaaccttagatgcatatcttttcaatgtcctttgtttctacatagcctacatagtaagggtagaagcggtgtggaaattttctaaccataccgatacagtttccctaaaatattacatagtcatgctgtagcagcactcggaatatatatgatctagttagactagttcttctctcaactttctcagtctcccctttatttttcacacgcacgtttcccaaactactaaacgatatgattatttttttttgaaaattttctataggaaatttgatttaaaaatcatattaatccatttttatttttaaacttaatacttaattaatcaagggggtcaatccactgtttcatttttcgcatagggaggagttcccaactactccctccgtccctaaatatttgacgccgttgattttttttaatatgtttgacggtttgtcttgtcaaaaaatttaagtaattattaattcttttcctatcatttgattcattgttaaatatactactattactcaagtttttgaataatattcacaaaagtttttgaataagacaaacggtcaaacatgtttaaaaaagtcaacggcatcaaatatttaggaactaaaagagtactacaaacgaacgaagcctaggcttctccatataaggctgtgtttagttcacagcaaaattaaaagtttggttaaaattgaaacgatatgacggaaaagttggaagtttgtgtgtgtaggaaagttttgatgtgatgaaaaagttggaagtttgaagaaaaactttggaactaaaccaggcctaaatgaacattcgatggctcctctagaaacattcttgatcttagcattcagtttggaagatgaaatggcattcacacgagcattgcagattttcatggtccatctggctagcagagaccagagcgtcgtctgcaaatgcatgatctgagcaaacctttgcagtctttgctgcgttgcgttgacggtcagtcaacccacacacacacgcatcatgcaacacattgacagattggccttaacttcactcggtaatttatttcatcgctgtaactatggcatgttagactacaactttcatccgttagagcaggtacaatagcaggctgtaaacatattttaataagataaaagatgagagagaatagcagtgggctatagatctatagccagctgcagcgtggactccaagacacaatgtgtgtatgacaggtggtaccatatattaatagtatagtaaacaactatcgtataaattacctattatattggctataaataaattaaagttagtagtgggttatactattaaacttgctcttagaaattgatcccctggcctccctttatattagttgcattcctttgaatgttccacacttgtttagcgaattaaatttaaaaatatactgttaatttatttttttttctcgaaattttcaggatatatttttttaacagaaatatatcgtcgttctgtcacaaacattacacgaacatgacgacgcgggcgagacggcgctacctcacacgatgaaatagctagaccgagcagtaccagcgagcgagaccgaatggctggccgattcaaactgtttaattatctgatattaattaatcgctaattagaatgattaatcacttgttattattaattaattgctaattgggtaagtctctaattatgcggcagctcactgggcaagccgttcgctctctgctcattcattgtgcgagattgcttggtctcgttgtttcgtcacgtgagaccgcgcgatacgctatggttgcgcacagtcaccgtgcaagaccgtccgcgtcatcacacctcacgttgtttgagatcgacagtttatttctattaaaaaaataaatcaacagtatatttttaaatcaaatctaattacttgtttagctgtatatcttttcaaaatcgattatccctacatagcatatgtagtaggggtaaaaacggtgtcgaaattttccaaccgtaccaataccatttctaagaaatattacatggggtgtgttatgttgggcttttcaacctgcttttacttttgcttttgcaaaagttaaaagccaactaaagggctcaaaaatcataagtacttttgctccaaagctgcttttagtgcagtacaaatctaaaagcacccctacccctgctttcattggcttttgagtaaaaaaaaattacccgcctctctcattataaagaaaacggttcgacaaaaataaaaattaattacacagattacgtgtaaattacaagacgaatcttttaagcttaattgcttcatgatttgacaatgtggtgctacagtaaacatttgctaatgatggattaattaggcttgataaattcgtctcgtagtttacatgcggattctgtaatttgtttggttattaaactatatttaatactttaaatgtgtatatgtatatttgatgtgacacagtaaaaaactttacccataaatctaaacacagtcttaatattctacgcgtgtcacagtgtgaaattttttgttatgaactaaacagtttggaagatgaaatggcattcgcacgagcgttgcagattttcatggtacatctggctagcagagaccagagcgtggtctgtaagccagacagcccatatgcatgatctgagcaaaccttgcagtcgttgctgcgttgcgttgacggtcagtcaacccacagacacacgcatcatgcaacgccattgtcagattggccttaacttcactcggtaaggcctggtttaggccatgtttagttccaaaaactttttttcaaaaacatcacatcgaatctttggacatatgtataataaaaaactaattgcacagttatggaggaaatcacgagacaaattttatgagcctaattagtccatgattagccataaatgctataataactcacatgtgctaatgatggattaattaggctcaaaagattcgtcatgcggtttccaggcgagttatgaaattagttttttcattcgtgtcccaaaaccccttccaacatctggtcaaacgtccgatgtgacaccaaaaaattttcttttcgcgaactaaacatacccttaagtttcccaaatttttttccaaaaaacatcacatcgaatctttggacacatgcatgaaacattaaatatagattaagaaaaactaattgcacagttagaggaaaatcgcgagacgaatcttttgagcttaattagttcataattagccataagtgctacagtaactcacatatgctaatgacagattaattaggctcaaaagatttgtctcgcggttttcaggctagttatgaaattcgttttttcattcgcgtccgaaaaccccttcccacatccgattaaatattcgatgtgatacccaaaaattttcttttcgcgaactaaacaggccctaactcgactcattcactcgcgaactaaataggccctaacttgactcattaaggctgtgtttagatccaaagtttagatccaaacttcagttcttttccatcacatcaacatgtcatacacacacaacttttcagtcacatcatcttcaatttcaaccaaaatccaaactttgccctgaactaaacacagcctcactcactctagtcccagtcaatctaggtggctagctgacagcaaaaaattttcgccatgtcacatcgaacgtttgaacatctgcatgaagtattaaatataggttaaaaaatcacatattgcgactaatttgtgagacgaatcttttaagcctaattgctccatgatttgataacgtggtgctacagtagacatttgctaatgatggattaattaggcttaataaattcgtctatctgtttactgacggattctgtaatttgtttacctgaatacctcatatgacaccccgccaaaactttaccccctcgatctaaacacccctgaatttgctatactagtatataatattctccagccggatccttcctctcggacgcagcaatggcaatgacgatgctcttcagtctgctgttttgcacagctaaggctactgatgattcaggagcagaaactgaagcagaagcactcctccgatggaagtccactttgatcgacgccaccaactcgttgtcgtcatggtcgattgccaactccacctgctcttggttcggtgtcacctgtgacgccgccggccatgtcactgagctcgaccttcttggtgccgacatcaatggtacgcttgacgctctctactctgctgcattcgaaaacctcaccaccatcgacctcagccacaataatcttgatggtgccattccagcaaatatttgtatgttgcgcaccctcaccattctggatttgagcagcaactatcttgttggtgttatcccgataaatatttccatgttgattgctctcaccgttctagatttgagcggcaataatcttgctggtgccatcccggcaaatatttccatgttgcacaccctcaccattctggatttgagcagcaactatcttgttggtgttatcccgataaatatttccatgttgattgctctcaccgttctagatttgagcggcaataatcttgctggtgccatcccggcaaatatttccatgttgcacaccctcacctttctggatttgagcagcaacaatcttactggtgcaattccctaccaactcagcaagctccctaggctcgcccacttaggtcttggagataaccacttgacaaatccagaatatgccatgttcttcacacccatgccttttttggaattcctatctctatcgagaccttttacagtgtttacattcctaaaatggcatagatctaacggttcacgatgaaaggtaccttatgaaaggtatcagaggtagaaaggtactaagtattaaaaggtaattgataacagggcaattatgtctaacaacgtatggacgtaccgaaaggtacggtgtaagtggatttgaaggtaccacaaggtaccacgtaagtagtttttaaaggtaacgtaaaatatgatttatgtggtggggacaaaaattacattctcttctattcggtttccaatcttcggtcgttctgtttgcgtcggtttccaaactttggtccgatttacgtggtacatatcatattcgcatgatcttgataattatttccagatagtcattaatttacatagcaatttggtgatccatcgtttgatgaatgtaatcaaagatcgaaaggacaacaaattgagaagatttacgcacctaacaagaacaaaacaagttcaatgaggaagatttgcgaaaaaaaactaaacaaatcgtctgacagatcgggaccgtgcggccgcttctagctccggcgaacataggcagtcctggaccacttcctccgggtcctcttcctccaccgcccctccctccaaccaccgcctccggccacacgtccaccgccggccctcaattctcctcctttcaacttatcgaagaacacgtaaaccttacgtacgaacagaacgtatctaagaatgatgcaacgcaacatgctacaagctaattccttcgataccttctcatacctttttatatgtgtaaaagacacatttgtcattctaatatcatcatatttacattaatgccacctattacaatattttctttccataccttgcccctcgcagatcaacggctcacgtcgccccacctcctttacctcgcaaacatcgtaaaatccctcatctctatcttacaattatctcaacggtacttttccagaattcatcctcaatagcaatagtttgaggatggagcacctcgatttatcgtataatgccttctcatggtccataccagattcactaccaaatttgagggttctagaactgtcgaacaatggattccatgggaccataccacattcactctcaagactacaaaagctccaagacctatatctgtacagaaacaacctcaccggaggaatcccagaggagcttgggaacctaaccaatcttgaggccctgtacctgtccagaaaccggttagttggaagtttgcctccctcttttgccaggatgcaacaattatcattttttgcgatagacagtaactacatcaatggtagtatcccgttggagatattttcaaattgtacttggctcaactggtttgatgtttccaacaacatgttaactggaagcatcccaccactaatcagcaactggacaaatctacactacttggccctctttaacaacacatttaccggtgcaatcccatgggagataggaaacttagcacaagtatatttagaggtggacatgtcacaaaatctatttactggaaagataccattaaatatctgcaatgcaactttggaataccttgcgatcagtgacaaccatctagaaggcgagctccctggatgcctgtggggtttgaaaggtctcgtttacatggatttgtcaagaaacactttttctgggaaaattgcaccctcagacactcctaacaatgattccgacctactcgccctggacctgtcaaacaataacttttcgggttatttcccagtcgtactgaggaatctcagcagactagaatttttgaatcttggatataataggatttctggtgagattccttcgtggataggggaaagtttttctcatctgatgattctacagctaaggtcaaacatgttccatggaagtattccttggcagctatcacaactccccaaactacaattgcttgatctagctgaaaataattttacaggctccataccaggtagtttcgccaacttatcatgtttgcactcagaaactagatgtgtgtgtagcttaattggagtatacctcgatctagatagtagacactacattgatattgattggaagggaagggagcatccatttaaagacataagtctacttgcaacaggtattgatttatcaaacaattctctctctggtgagatcccttcagaattgacaaatcttagaggtattcagtccttaaatatttctagaaattttctacaaggaaatatcccaaatggaattggcaatctaacacatttagagtctcttgacctctcttggaataaactctcaggccatattcctcatagcatatcaaacttaatgagtctcgaatggcttaatctctcgaacaaccttctatcgggagagatacctacaggtaatcaactcagaacacttgatgacccatcgatttatgccaacaacctggggctttgtggatttcctttgaaaatttcatgctcaaaccattcaagttctacgactacactagaaggggcaaaagaacaccaccaagaactggaaactctatggctgtactgctcagtaactgcaggagctgtctttggtgtttggctgtggtttggagcactgtttttctgtaatgcctggaggcttgctttcttctgtcgcatcgatgccatgcagcagaaacttatgtaaaacatagctcatctgagtaatatgctctgcttctcattgagtccacctgagcgtgtgtattagtgtcacattatgtcagcactgcactaagatctaaggttcagtaggtattatccctttatttcagccatcgatgagatgtaatttgctgttgccagatttagcttgttgttgttgtcatgatgaactcttgttataagcttttagtgtaagtcgggtagcatccttggtcagaaaagaaaatttacatgttttgatgatgagaccaatttcctacatggttgtgtttgaagatgcaagtagcatgtaatcaaggaagttccaaataaagtagaatacatcatggctgtcttttgatgtatttgcaagctttgttattacctttggatgcatacagacttcatttgacgctaatttggagaattttgtcttattttctgttcatactgtaagctgtatgtattctgttttttttttctcatcagctataaattactgcagtacacttctaagcaaaagaacacagctttgccggttgcagcaacaatactgaacacaacaagaacacgcgtggcaaaatttctattactagaatttcaccaaattccgacaaaaaaggtggagaaatcataagaacaaaatcacgctatccactgaaaatttccaggaagaattgcaaatcaactccccttgtgatcagtggccgctgttcacgacagcgcagttcctcctgatctccccctccgatccggtcttgacctgcaccgcgcccagcgtcgccatcgaccggccgaacacctggaagaacacctccggcgggctcgccacgacgccggcgatgtccgcccgccccgccacgtcggtggcgagcgcggcgttggaccggagcaggccgcggtgttagagtatatgatagttaaagttatattaggatatgattggtttgtttggattccttccatatctataatacttccttatttcttcctcctatatatattggatcccctgagactcaatacaatatgtcccacgttacgcagtatacctctcctatactatacaacatagtatcagagcgggtgatctaaggccaatgccgctcacgcttccgctcgtcccccccggagggtttcgatctcccgggggcggccacccgtttcctttttttttcgctcgtcgagtcttcgcggcctgcctccccagaggagtcaatctccgggctgcggccgcggcctgtccgtcgtcatcttcgcgtcagcaggccctccgtcaccgtcccccgcgccctcagattcgtctacaccgccagcgtgtacgtcgccgggtcacccctccaccggcgcgctgctcccaacggcgccacccccgtgccggtggctcccgacgccaccagcctcctcgactccgccgcgaccacgtggtgaccaccgcgccaacggccgacctcagctccgccctgccggcatctggaggacgccagcagggccctgcgcctcaccactgccggccgccaccaagctccggctgcgtcggctcccggtccctgccggtcaagcacgccgccctccccgcgccacgtctccaggaacaaccggtctcctctcattcccttccaatggtctgtctgcacgtgtcacatgtgtgggtggataagttttggggggatagctggctactggtacggctgaggcaaaaggttagctggactttggcctatgtaccggaccatcgagcaacaggggatgctaccgtactgttgctgcttgtatttttttttcgcccacaagagacaattctttttagcctctaagagacaaaaagaagagcctaacaaggaccttgagataacagcccattcatagaacgggtttgcgtcgcccaccgcctcgtcgacatctacgcgtctccgatatcggtatcgactctgcttcgactttatcgttccgcctcgcgcatcttcggcttgatcacccgttcaagcgcccggctacaacgacttctacaaccgatcggcatcaagcacgcgtctacactatcaaacttcgggttgccgctgcatcgccctcttgggctgcagtgtcgccgcccatggtccacctccactggttgttggaacactgagaggcaacacctccactgcctcgcccgcgcggtattggcaacaccggcgcgcgtgttcgtcccgagttgtccccgggtctggcaaatccggcatgacgtctcgtctttcacggttcgactacatcggctcttcggcatcatcttcctcaacgactgccgcgattgtgtcaccgtcttcgtctcccgcgcatcctcgcgcaccttggtccacgatgcccctcccgtgcgtccacgaccactctacgacggcccatgcgcgctccgcggctcggctacctcgacatctatttttcgaccacagcactcttgccggtttcttctccagtctaagtgtccgcactgctcacgcttggactgcggggggatgttagaatatatggtagttagagttatattaggataggattggtttgtttggattccttccataagtgtaatccttccttatttctttcccatgtactcctgtatatatcggccctctgaggctcaatacaatatgtcccatgttacgcagtatacctttcctatactattcaacacgtggtgcctgagcaccgtgcggtagtagccgaggtcgaacgtcaggtggctgccggggtccatctccaccacgccgtcgccggctgtcctgcacttgcgctcacgcaggttggcggcgtccagcggcggcgggtcggtgctgttgctgttggcattgccagcgccgccgccgccatagaggcggtcggcgaaggatggtgtgcgcacctgcgcgatcggatgcaatttttcagaaatcattttacatccaagaattcattgtgataatgtcacacatgtgtcctcattcttgcacaaaaacaagcttgaatttttatgatgttggcttgctgtagatcgccattttcgggacatgaatcgagcatccaaacgattgggttgaaatgcaatttttttaatgaaaaaatcaacgtaatttttcccctgttgattgtcaacaaagaatctataaaattttctcaagacatgcatgagagagtctgcagctaatttcaaattttcggttgatttgatgctctaacatatgagattatataaagctaatttttgttcagtttattataccagtcataaatcataacagtataaaattgactatagtcaccaattatagtgaccctccccaactattgaaaccagggtaatttaactcacaatacagtattgatagtggtatttactaacgtgacttctacgtggcatcccaaacatcaaataaatttaaaaactaagtagggctcgcctgtcaaccccccccctcccctcccctcccttctacccctctactaacctctgtccacctctctctccccatttcttcttcttggcctaacagcagcagggtgccgagacgacgacggggagcagcgggatgatggcgaggctctcctttctctcccaccccggtcccttctgtccaggcgctagtggaggagtggccggccgagtgagatgcggggtggcagtaggcagcgagcccgggtggtcctcatcatcctggccgggtcgcctgagttcgagttcttggatggtggggaagaacccctcctcgttccagtccctagaattcgagttcaagttctagatagtgggaaagaacactgcgagatgaccacagcatgcctgctgtcaccgtcgtgcgggtatcacggcccgattggctccgcaaagccattgcgtgggtgtcacgggagcacgaatgagccgctgtggcacgtcatcctctctcccctctccctcgtacatctccacctctttcctcatatatctccacctcttccctcactcttcttgtgggctctggcggtgtgacgaccagcaagaccatgggcagtgcctagcggaagatgaaccaaagatggcagcgaccatcgcaagtctcaacttaagagtgatgagcatgctctccctcctcccgaccacgcgccaaccatgacgctgccgccatcaccgccaccgcgccgcgccgtgctgctcgaccattatcctcctagttgtgcgtgcacccttatatctcccctcccttcccactcggggattctctctcactttcatctagtgcgtgacggagcgctggcggtacaccagtcccccagccccttctctagcgtcggtggcacactagtcccccaacctcctctttggcgccggtggctacctccggcccgggcccttgccactgctccctccctcgccactgccgatgggggggggaatggagatagatattagatagggagggggatagtgagtatgacaagtgggtgatatattttctttttaaaaaaaatattttttttaaaaaaaaatctctagtcacttacatatggaccttcaatttctactttgtgactatgctaccatatcaacacagagttgaccaagtcaacgagcaatgtcagcgaaaaccgttgagaaagtcaaattgtaccggtttaaataactagaggtccaaggtattcaagatcactaattagcgatcgatcgccccagacgatcatttttcttttcatcactttcccttttttacaccatatagtttttcttttggtaagtttatatacttaaagtttctacatctaaagtttacgcacctaaattttaaacacccaattcaaatttaaattcggatttaaatttgtagagcgaatatttataagtcaaaagtttatatagccgatttaaattcaaattcggattcaaataatttatatatagaatatttctatacataaagtttatgcgtgcaaagtttacggtataacctaaagtttatccgtttgtagagcgaatgtttataagtcaaaagtttatatacctgattcaaattcaaattcggattcaaatattatatatatagaatatttatatacataaagttttatgcgtgcaaagttttacggtataaagtctatgcacatgaatgagagtattagatgaaatttatgatgaaaggagggaagggagaggagtataaggggttgatctcccgcccatttggggctcggtattgaggttgtggagtacgattaagattggagccgtatttgagggagtcaatgtggacttattgcaagccagaaagccgacgtttccgcggagttctcaattgggcccacaacggcccatataacttggtccggaacgggattgcatggtaggagcggcccacgttgtgtgtgacgacgccgactccctcgacaggccgccgcagcgtggcttgccactacccccgcgcttcgctgtgtccgctttcccagcacagatcaaatggccgccacctccggcgagctcctcacccacgcaaccatggtgctctcgctctctccgattctccagcacaaaccgacggcgagctgccctccttatcctccgatgtcggatttaagcaaaggcgagataaggatctgccatctccttataataaatagtactattagcatccatttgatattggcaattcggctttgtgtataacatcattggtgatgtggaatggtgacgctgtcagtcagtcagtcaaagtaatcaaccgcgtggggtgcttttatctcgtgaatctttcctttccaagatgggtggtgagctgcgcaatagattagagagttgggtgcccattatcattatattgtcattataaattcatccatcctgcaaagtttttcttgacgccgagcatgtcaatgggcaaaccaatcctcactcagtctcggtctcttcgcccgggtgaccgatagtggcatgttaatgcagctttagcttccaactttcagttagaaattgatcccacggcctcccttcaattttactttttttctttttgtttaacacttgtttagcttgcatatgttttttaaatatttcgtcagtacatagtcatcctgtagcaacacccagaatatgtgtacaaagtgctacctacggagtatttgacactgggaattcaacttattatcaacaattcttatctatactaacatccttggtgatgagacagtcaagtcatcaactatgtggactgtggagtgtctttattctgtgaattttcccccagccatataaacattccatggtctggtatgtccctcatggtccatctgtctagccgagcccggagctttactgaggccgtttttagttccttttttattttttttaaagtatacagacacacatttgaattattaaacatagactaataacaaaacaaattacagattccacctataaactgcgagacgaatctattaagcctaattaatccgtcattggaaaatgtttactgtagcaccacattatcaaatcatggcgtaattatgctcaaaagattcgtctcgcaatttacatgcaaaccgtgtaattagttttttttccacatttaatgcttcatgcatatgtccaaatatttaatgtggtgaaatttttgaaagtttgaaaggaactaaacacggcctgagtcatctgtacgcctgccagcccatatgcatgatctgagcaaccttgcaggctctgctgcgttgatggtcagtcaacttcactcaacaagtcactcactccagtcccagtcaatctaggtggcttacagtatttgaatgaatttgctatactattatataggagtattctccaaccgatccttcctctcggacgcagcaatggcaatggcaatgacgatgctctttagaatctgagtctttctgctgctgttttgcacagctaaggctactgatgattcaggagcagaaactgaagcagaagcactcctccgatggaagtccactttgatcgacgccaccaactcgttgtcgtcatggtcgattgccaactccacctgctcttggttcggtgtcacctgtgacgccgccggccatgtcactgagctcgaccttcttggtgccgacatcaatggtacgcttgacgctctctactctgctgcattcgaaaacctcaccaccatcgacctcagccacaataatcttgatggtgccattccagcaaatatttctatgttgcacaccctcaccgttctagatttgagcgtcaataatcttactggtacgatcccctaccaactcagcaagctccctagactcgcccacttaaatcttggagataaccacttgaccaatccggaatatgccatgttcttcacacccatgccctgtttggaattcctatctctatttcacaatcatctcaatggtacttttccagaattcatcctcaatagcactagtttgaggatggagcacctcgatttatcgggtaatgctttctcagggcccataccagattcactaccagagattgctccaaatttgaggcatctagatctgtcgtacaatggattccatgggtccataccacattcactctcaaggctgcaaaagctccgagaactatatctgcacagaaacaacctcacccgagcaatcccagaggagcttgggaacctaaccaatcttgaggagctggtcctgtcaagcaaccggttagttggaagtttgccaccatcttttgccaggatgcaacaattatcattttttgcgatagacaataactacatcaatggtagtatcccgttggagatgttttcaaactgcactcagctcatgatttttgatgtttccaacaacatgttaactggaagcatcccatcactgatcagcaactggacacacctacagtacttgttcctcttcaacaacacatttaccggtgcaatcccaagggagataggaaacttagcacaattactttcagtggacatgtcacaaaatctctttaccggaaagataccattaaatatctgcaatgcatctttgctataccttgtaatcagtcacaactatctggaaggtgagctccctgaatgcttgtggaatttgaaagatctcggatacatggatttgtcaagcaacgctttttctggagaagttacaacctcaagtaactatgaatcctccctaaaatcactgtacctgtcaaataataacttatcgggtcgttttccaacggtattgaagaacctcaaaaacctaactgtgttggatcttgtgcataataagatttctggtgtgattccttcatggattggggaaagcaatcctttgctgaggattctccgattacgatcaaacttgttccatggaagtattccttgtcaactgtcaaaactctcccaactccaactgcttgatctggctgaaaataattttacaggtcctgtaccaagtagtttcgccaacttatcctccatgcagcctgaaacaagagacaaattctcctccggtgaaacatattacattaacattatttggaagggaatggagtacacttttcaggaaagagatgattgtgttattggtattgatctttcaagcaattctctctctggtgagatcccttcagagttgacaaatcttagaggccttcagttcttaaatatgtcaagaaatgttctatatggtggcatcccaaatgacattggccatctacatgttgtagagtctcttgacctctcttgcaatagactcttgggtcctattcctcctagcatatcaaacttgacgggcctcagcaagcttaatctctcgaacaaccttctatcaggagagatacctataggtaatcaactccaaacactggatgacccatcgatttatgccaacaacctgaggctttgtggatttcctttgaaaattccatgctcaaaccattcaaattctacgagtacactagaaggggcaaaagaacatcaccaagaactggaaactctatggctgtactgctcagtaactgcaggagctgtctttggtgtttggctgtggtttggagcactgtttttctgtaatgcatggaggcttgctttcttcagtctcatcgatgccatgcagcagaaacttatgcaaacataactcatctgagtaatatgctctgcttctcaagttctcattgagtccacctgagcgtgtgtattagtgtcacattatgtcagcactgcaccaagatctaaggttcagtaggtattatccctttatttcagccatcgatgagatgtaattttctgttgccagatttggcttgttgttcttgtgatgatgaactcttgttactagcttttagtgtaagtcgggtagcatccttggtcagaaaaaaagaacatgttttggtgatgagaccaatttcctacatggttgtgtttgagatgaaagtagcatgtaagccaggaagttccaaataaagtagcatacatcatggctgtcttttgatgtatttgcaagctttgttattacctgtgcatgcatacagacttcatttgacgctaattcggagaattttgtcttattttctgttcatactgtaaactgtatgtattctgttttttttttctcatcagctataaattactacagcacacttcaaagcaaaagaacacagctttgccggttgcagcaacgacactgaacacaacaagaacacgcgcagcaaaatttctactagaatttcaccaaattcaaatgacaaaagtgaagaaatcgtaagaacaaaatcacgctatcccaggaagaattgcaaatcaactccccttttgatcagtggccgctgttcacgacagcgcagttcctcctgatctccccatcggagccggtcttgacctgcaccgcgcccagcgtcgccatcgaccggccgaacacctggaagaacacctccggcgggctcgccacggcgccggcgatgtcggcccgcgccgccgcgtcggtgactagcgcggcgtcggaccggagcaggccgcggtgcctgagcaccgcgcggtagtagccgagatcgaacgtcaggtggctgccggggtccatctccaccacgccgtcgccggccgtcctgcacttgcgctcacgcaggttggcggcgtaggcggcgtccagcggcggcgggtcggtgttgttgccgttggcattgccggcgccgccgccgccgttgtagaggcggtcggcgaaggacgagcagtgggcgatgccgatggtgtgcgcgcctgcgcgatcggatgcaatttttcagaaatcattttacacccaagaattcattgtgataatgtcacacatgtgtccttaactcctcattcttgcacaaaatcatgcttgaatttttatgatgttggcttgctgtagatcgccattttctggacatgaatcgagcatccaaattttcggttgatttgatgctaacttacgagattatataaatctatttatttcagtttatttacattggtcataaatcataactgtagaaattatgacattgctgaacaagttaagtcagttcaatggtagataaaattgactagtcatcaacacgaactgacagatagaaagcaactattattcgtgctccttttgcatgcagacatgcagatgcctagtcagcaaacaaaggattggaaattcagacacaaagctttcctctctgaaattaatcttacagcttctacattatgtctcccaccgacagtgcagattaattacatgctaatagtgtagtttggatctgattaactagagtaatctgtttagtttagctgataactgagattaattacatgctaacagtgtaatttggacctggttaactagagtaatccaagttgtttagtttgtgcagataagtggtactaagtatcctcggtttcataatataagttgtttcgaattttttttgtcaaatttcttgaaaatttgatcaaatctctacaattataaaaattaaagatatttccgcgatctgttatctgtgtttgagtcggttttaattttatattttgattttaatctataactctatctcttgtctactattataaaaattgaagatgtttttaccggtactttggtacgtcatctttgtatgagtcgatttttaagttcgtttgcttttggaaatacagatccgtatttgagtcaggttttaagttcgttcgcttttggaaatacagtcatataagaaatctcaataaaaaactcacatgctaacttggcatgattttctagaaaaatatatatccaagcgaattctcacggtgaatttcagagtgaacaataataagattaaaatagacttcacccattacaacgcacgggcattttttctagtttataaaaaaaatataacactcataacaccaaattaatttcattacatctaacatttaacatattttgataatttctttgttataggttaaaaatattgctatgtttttcaaacctaaataagtttggcttagaaaataatcaaaatgacttataatatgatgaaacgaggatagtaattaataatgtgaattaatgaattcgttcataatcgtcacgtacctgacagccagacaaggtcacgcacgctgaggcccttggtggcgaacaagccggcgagctccgggaagctcatcgccggcgaggggatctccgcgagcgcctcctgcatgctcgacaccgtgccatccctcctccccgtcggcacgcgccacgacggccctccctgcagagcatgttcagcatcgtcaggctccggccagtgcgcgcggcgcgcggcgaccgtggcgagcgctcgagagcttacgatggcggcgacggcgtcgcgggcggcgagcgcgaggacgtcggcgcaggagacgacgcccgggcaggccgcctccacgaggcccttgacgcggtcgatgaggtcgaaccctcgcagcgtctggttcggcgccgcgtccttctccgccgcgccgccattgccggtcgagttgaggaggatggacgcgtcgcagccctttttgacaaacgcacaacacattccatcaaacacattgcagacattgcacgcgcatcaatggcggccgcgcggcgcggcgcggcgcacgtaccctgacgaagcagtcgtggtagtgcagccggaggagcgcggcggcgacggtggggacgcggccgacgtgctgccggacgtactccccgacgatccgctccgccgcggggcagctctcgtcgtagaaccccatcctgagctgcgcgcgcgcgccgccgatcacgccggcgccgaggacgacgatggccgccactccgagccggatcaccgccattggcacgccgcccgcgcgtcgcctcctcgtgctcgccattgccgcccactcgactactcaactcaacttaactcaactcaaaacttgtgaagtgaaccgcttatatacactagtatttatagtcctgagcttacttaacagacatttcttcagagagtgagattacttcaaacttagttcgaaatctattttttgagagaaaaatgcagtataaaaagcagggtaatttaacttggattcgccaatgattttgaaaggaacagtgaaaaatatgcctccacatgcacgcacgcaaaatggaaccgggagaagcgtgtgacagtgtcacttgattcctctatctatttctttcgctttaatttctctgctttatatctagcttcttttagtctttttcgaatcatgtttaacttttgcaatcttgatgatgaattgatgggtgatcgattggtacatcgtgggtggaagaaagagcaagaaaagaacttgatcctttcctcctctttcctgccattgccttgcttaggcaaggttccaaagctctgaagcttcctcctcccttttgtcagacttttggcttggatcattttttggattggaaagtatttgtcattgcttgataggttgctgtttggtaatttttagtgccaccaccgacaacagggttgatcgggattgttaaatcatgcattcctggtcacaattcgcaatcacattcatgtggaataaaattgatgaacacgctttgctgagaaaaaggaagaagagtgaactaatacgtttttcaatttcggtgtatacattataagctttatattaccaaggggcaagggaaagtttagtaaattatcgcgtatggcacagccacggatcaaaaacaatgtgagctcaaatgctatgtctcggaaacatgtccacctctccatcttctatttgtgttccaatgcttatgtcaatcaatcagattttggtgatgcacgcatcagagagaatttttcccctagccgtgattttcctttctttctaacggttttgaaattgcaagtattggagtatatcatcattctactattatcttccaatgctacgaaatagagaaatcaagcagcgaagaaacaaaaagatgttacatgagatgacaaattaaagcccaattacctcgaatcatatatcaaattgaatgtcgcaaagatttcaacacacgcctacagcgttctgaaaagaaagcccaaatgctcatagtggctccaaatataaatcaggacagcatagtccttccagcatcacttccctccagaataatcttttatatcccataggccattgcaaagctcattaagataaaagtaaatgacgatttaataagaatatgcagcattttcaaacttgcaactcagataaaacatcaacaggaatgagatgcaaatgagcaaattgagcacatatttaggttcaaatccaacttattcataaagcatactgctgtcccacaggaaactgtttcataaaactaacatatcatacggactcgatggtccattaaaccagacacaagtagacatcagcaccacaaatacttgacgaacagaggctcgggacgaccaggcacatcggcagctccaccaaactggctgattactgaccaccacggaggcggagcaccaggtggagggtggactccttctggatgttgtagtcggcgagggtgcgtccatcctccagctgcttgccagcgaagatcagacgctgctggtctgggggaatcccctccttgtcctggatcttggccttcacattatcaatggtgtcggagctctcaacctccaaagtgatggtcttcccagtcaaggtcttcacgaagatctgcataccaccacggagacgaagcaccaggtggagggtagactccttctggatgttgtagtcggcgagggtgcggccatcctcgagctgcttgccggcgaagatgagacgctgctggtctggggggatgccctccttgtcctggatcttggccttgacgttgtcgatggtgtccgagctctcaacctccagggtgatggtcttgcctgtgagggtcttgacaaagatctgcataccaccacgaaggcggagcacaaggtggagggtggactccttctggatgttgtagtcagcaagggtcctgccatcctccagctgcttgccagcaaagatgaggcgctgctggtccgggggaatgccctccttgtcctggatcttggccttgacattgtcgatggtatcagaagactccacctcgagggtgatggtcttgccggtcagagtcttcacgaagatttgcatgcctcccctgagacggaggacaaggtgaagcgttgactccttctggatgttgtagtcagcaagggtcctgccgtcctcaagctgcttgccggcaaagatgagacgctgctggtccgggggaatgccctccttgtcctggatcttggccttgacgttgtcgatggtgtcagaagattccacctcgagggtgatggtcttgccggtcagtgtcttgacaaagatctgcatgccaccacggaggcggaggacaaggtggagggtggactccttctggatgttgtagtcagcaagggtcctgccatcctccagctgcttgccggcgaagatgagacgctgctggtctggggggatgccctctttgtcctggatcttggccttgacgttgtcgatggtgtcagaagactccacctcaagggtgatagtcttgccggtcagagtcttgacaaagatctgcatgccaccacggaggcggaggacaaggtgaagggtcgactccttctggatgttgtagtcagcaagggtcctgccatcctccagctgcttgccagcgaagatgagacgctgctggtccggggggatgccctccttatcttggatcttagccttgacattatcgatggtgtcagaggactccacctcgagggtgatagtcttgccggtcaatgtcttcacaaagatctgcatctgcaagaaataatcaccaaacagatagggtaagaactagcacaagattaaggacacaacaacggatcaaacagcaaacatattccaacagaacatacatgtattcaaaaagatagtaacaggcacatcacacatgtattcagataggtagtaacagcacacgtatcctgaacttcagaaataagtagaatgaactagtggcaataatcttcacacagatagtaaaaagaaattaccacaatagattatatagatgaactacagattgtaacatgatattactacagattgtaacatgatattctaatatagttcttagcataaattactggcagatagtaacatgagatcattatgacagatatagcgacaagacttcctatttaccattgacaattaattaaaagagttcatcattatctaatctgtgaacatatgaaatcaaatcgaaacgcacaagctacataattgaaccatgtctaagaagaactaccctacagatctacatcaaacacaaaacagatataacatattaaagcctgtgtttgcaccaacccatggcaccaataactcaatcaagagcggaacagtagatctgaacatgctcgcaacaaggcctacaagatggaacacgctacaaatcgcaccaatcactcaggcatgactagttccacaattccccaacagatctacaccgatttccccaatcgaatcatccaacaattcatctaaccgtaaaaattccccccaatcatcagaaccaacatccaatcccaaaacctaaccacgattccacctatcgaaccaaccgtgcccaaatcacaaccatcagatctacaacccctaaacatctcacgataatcacatcgacaaccctaaccaccaatcggatctagcaacaaaacaacctcacccgtccgaaatcgaatcgaaacgaagcgaggagaggagaagcagcgtaccttgaggacgcgagaggattcgattcgacgacgagagcctcgcgagattggggagaaatttttcgggggtggagctgatgcgaggagaggagatgagggggctggtatttatggcggttgggtggtgggaggagtcccgtgccgtgacgtctccgtctgcttggagaatccgccacgctgaaaccaccgcggtttccgggaagacgaggcgggcgagcgagcggttgggaaatttcgagaagatgccgtttgtctccgtttggtacacgtctcgttgattttttttgagtgaattacgctttggaccacattttattatctataagttttactttggactacctttaaacatatcttttcactttgaaccagataaatttgctattgttgcgatttggatttttttttctcgtgcaatcaacgaccttaaacacatcagctctagtatacggccgatctcctctatatatggttcatatgtttgctgaaagggaagttagacatgacgaaaagttgttcatggtagtccaaaccacaacccggcccaaattgaaaagataggtttaagggtgatccaaattgagacttaggtaataaaaggtggatcaaagtgcaatttactttttttttactgtaatttcttctggctggtttgttggtcgccgttaggaccgggtgacgccgtcaaccccgcgcctccgtatttgctgacgtggggtggcgcgctggcttccgccttgacccgaatttgttttccttccgttaaaaaaatggttttccttttcttaaaaaggaaatagtttgttttttaagtctgtgtattaggattattacacttgaattttggtatatgtgtaggataatttactgcatgtttataatagagttgtactatagatgaaataacccaatttttggtataattcgtgtttggttggaggtcaaaataacaggttattttgtgaagaaaaaactccgtagtatagtaccatatccatcatgaatacacatactgcctagacgagtgattaggatgaatccatgttatattcctcaaaataatataaaccacttgatcttatgatcttatccaatctgttcatataaactggagatataagatggtgcatttcccttttgatttcttttgttgacggccatgagataggtttgcatccactgcatttatatttcggaccaatacaatgcacctattgatacatggggacagctcaactaaccatgatgcaaattgctggttggtgaccagttcttggcattatgataatgataggattaaaaaaaacagtgcaatgtctcggaaagaaaccatgacaaagggtacatgttgcattccagtttctaatgataaaattatgtgccagcaattcaaaaatcatgcgtgttccctacgcaccattctttgcaataaacaagtgcatgcacaatatgattgtgctaagggtcaagaacttgttgcagtggctaagttttggataagaccaatgaacaaacagtactagtagtttgttttatgaaatttgcatttctgcagctgttttctaacaatttcatacggcagcctatgctgattcacttggacattgccccctccataattctaatctttggttccaaataaaatcatgtgtaaccaaactgttgtagtatgaattatggattggtgtccttttttttccctccggactcctattggcaatgtaagactatatgaagtatcagatgccactcggttggagatttaactgaatttgacatgaataggcaagatcacacaaactaaagtgctccagaacaaaaacatgcagattaggctaccaacaccagcctgaaactgttcatggacttgctgcatacaaacaacacagtatataccatgagccctacaaggctatatgaatactgctgagaaagggagaaaaaggtgaggtaagaatgtagaaattaatagatactgtaaacaaactgatattccaatactaccatcatcttgacaacagcttgcttaaatcagaaatccacagttaccaacagtaatataacaagagttaacttcaacagtatttatttgtgcaacttaaaagacaccataggaagccttgaagctatcacccctatgctgaagtactgaaatgagaggaaaccatgtcgttcactcctttttcccgactccatgagacatgttgtacaccccacggccctgtttataaaacaagaaacatgtcactgtctgaacgtaaacaagaccagagaaaacaagcaacgcaggaatcaattaaaagaaccccagactcactatcataaacaagctggaggcggcaagagcgaggggaatggcaacggaggtgaccacatcataacgccctttcagatacgtgtgcttggtcaagttctgaaaatactgctgctgcttaaagagcctctcgcgcggcaaaaacggtgattctgtcattctgcatcacaacagaaggaaccaagacaaatctatatcaatatggaaagaaatttatctttcttatggacatttttgcatataaagaaaaacatacagaattagtataattactgtatttgactttgagaactaatgacactagaaatcatcactgttttccttaaactgcttacttagaggagtactaactaactgctatgcagccatatataagttgttaaatttctctcattagcacctaagttaaaataatgttttttacaaattaaaatacagctttaaacatgacacctaaacacatttcttcatgtgaagcaaatccatgtgttgtaaagcatacaaattttttttctttcatgatttaagcctaactagcgaaagtaccccagacagcgtgaactgtgatgcagaaagagattttaagccaaagaggtttcttggtcatcatcgcatagtttcatggctgaacatggctcatgaccaggattttatagagttaacagttagtcactcacaatcttcaaatcacaaaacctaaaaaaggaggtctgaagtatcaagtatgcaacaaagcatgcatatgttactaagcaacattgtatccgaacagtcttacacctattcaaaattacatgacctcaaacatacatgacaaattatacacctagagcctaccacttcattcctacaagcataatacaagaagttgacttgggcccaaaacagaaacaggttcgtcatttgtcaagcaagattgggccacaccaatacacaagaatattttattatgtgagcatagctgaacaatttctgcggggttctgaaaatcatattggcatcagagtcaaccaaagacaaacagatgctaaacacatactggtacagatcccctagatgtagccacgtcaccttcttctcccctttatggtgaacaccccttcctccatgcacgatagctgaacacctctccctctatatggtgttgcataatttttcattcacgcaatacatctatcacattttatcggtgaggcaatgagttatatattcgtaactaataagacaatgaataattttaagttacggcataatgctattttgtaattttcactgttgatcagctaatgaaatactccctcccttttatataagagaaaggctcttttgtatctaagaaaaaggagatagtactaaaattaattcaattgcagtaaacattagtgtccaaagtttctgagaaacaagtatataactactaatatgttgctgtttccagtgtgatatgttttcacacaagatgttccttctccaatcaaggattggttgtcaactattgatagagccccagaagctaataagatacagattacagagtggcatgtcaaaaggcagtataggtcccggatgcatcatgcatatagattgatgtgttgcagcggagtaagaatatcaggatcgaaatgatgtgtgacccgctagaaatcaaccaatggcttagatcagctgaaatccaccagattgatttggaggcaactccagggcatctgcacccaaactgatacagcgagatacacatacaaaaacacgcgagaaattccatccacgcatcaccaaaaaaaaaaaaaaagggcctcagattaataacgctccacgaatcgcgcaggtcgcaccaacatcaatcgcgtcaggaactcaagaaacacgaacagatctgctccgccattaaaacccctcctctctcaactcccaagcctcccaaccatcacatcgaacatcgaaacaacgaggcggaaatacaggaggagggaaacaccgcaccttgagacggaggcggaggaggaggacgacgacggattgattggacgatccttgcagcggcttgggggattttggatggatcgcggcgagaggtgaaacgaaatggggggaggaggaggcaacgacgaagaagcaggaacggcgaccgagtcggggaggagacgtcttgggaggaaaatgggccggattacttctggcccaacaccaaattttgggccaataataaggcctagtagtactatcaacagctgagggcgtgtttggttagctgcatttaagactatggctaataggtggacgattagctggtatagacgtggaagaggaaaatcagatgtgagagaaagaagctggctcctttacaatcgtccgcttggcatgagcgtctaggtgctttgacaacctagatccacgtcaagagatgggagatagagtgtacactaaacccacataatattaaaacaaaatattaatactagaacaagtgtgtagagcctgctataatataagatttagagccgatggtgggctcctatattattcttgatctaagggtggctcacacctatgtgtgacagttatttggttgtcagtatgaccgtcggggtctagttccagcattccattcatgcgaaacaaacacctgatccaaaatcgctagaaacacgaggaggtgagcttcgttcctcatgtaggttatgctcgtgcaggcaccaggtcggtgtaggaggtgagatagggtcacacattgagtcatctctctttctccaaatgctagtttgtgcctcccaatttgttgtcgcctccatcgtgccccctcaccagtggatccccttccccctcctctttggctatttgtagtatacggtgaaccacaacctcacaaccactagatctgatggtcgtaagttcagtactattggatctggtagtcccgacctcagtttggataaaacatatgagccaagctaaaggcattcgggtaaccaaacatactcttaaaatgtcatgaattttcatgtggggaataaattgattcatgtgaaatttgtattaagggatggttaggttctctattctataaagattcagcggcaccgttaccttttccctttaaggttgcgttcgtttgtgtcggttgggagtctatccctccggcacgaaaaacggaacagcttattatcgcataattaattaagtattagctaaaagtagctttaaaaatagattaatgtgattttataagcaattttcctatataattttttttcaaagaacacatcatttagtagtttgaaaagcgtgcacacgaaaaacgagggagagggattgaaaacctgcaatgccgaacacaacctaagaagggcttgatttctattagtagagaaaatgtggccaacatttgagcccgattttattagcattatcaaaaattgtgtttgactaaattttgatgaggtgtttagtttggtattaccaaactggatcaagaaccagaaaattgctcatgccatctctactagacgtctttttattgtgatgcttctaattaaactgatggatcctaaacctcttaaaccaaccgtgtcatgtgactaagtgacaactaacaaagatctctaaccagctaagttccacaaaaaaaaaaggtgatttttttatttgaaacgatacgcaaaaacaagaataagccttcagaaaaagaaagaaaaaatggagccgatttgcctgccaacagctgatccaagcctatcagagctgatcacacatgatgatcatgccacgattgacttgcaaatttaacggttatggattggtaggtgcgaggcatgaccggatcctgtctcattggcgtccatcatttcccaaaatcttatccagccaaatgtttctctcctctcctcttcatatcactgtatcaaaatgcatatatgattctaaatttctaatctctgtacctatcctaatccgacaggaaacagcttaattatcctacacttacatgcctgcaacaccacagaaaaaaaataggccaaaatgtattgaggggaagggcttagctggcctcttttctgtgccaagaaacaatgcatctctatctatagcttgcatatatcaacatatatattatttttatatggatcataatggaggtttctttttgtgttaaaaagttcagaaatgaggtgttcattgctgtgatggtttaagggtagattagtactagtggatacatcagtaagcaaatcagagaaggctgaccaagtttagacagattacagatggtagacacctgttatttctgcgtgatgaaatggcaacttgaattttttttattaaaaaatgaaatgaagagatacttcagaaaagttttgatgaagagcaccaggttaattctgatatattctgataacagaacgatagtgatgcctaattttccttgcgttgtgtttttaattagcttgcaagtgatgttattatctgatacacctccagccacaaatggatatttaatatcaaatggtaacacaagcaacctctagtgattggttgcagcttggtggaaaatttcatggtgtgtatagaccctagaagataaacaaaacttgttcataatacaaaattaagtcatcaggatcaggaagagatatccagagaaaaattcaaacacatagtgaattaagtggaatgggacagatcatcatccaccaagtgtaggaaatacgtttctttgagccatagaggataaggcactgaagaagtaggtcatactagttccatttgaaatgtctgcatgtgttgtgttatattgttttcttaactaacaagcttaggcaaaaacaatgagcaagcaatgacaaaaaaatccactggttttcttctttatccaatataaagatatgcagccctcctgaaagttctagacaaaaatgtgatgtaaaacttcatctgttaaagataaaattggatattttttaaataagaagatgatttgctgccatgtcagtaccacctaaaaagagccattctatgcaatgatccttaaaagtactaggactatactatacatctgatatgtaccatatcatctattacagagttaaccagcctattggcctgaaatctttcaataatatacctacccatttgagctgcaaagtttgttgttttacttgtttgcatgacaagtcaggtgtaagacggaaaaacttgaagcctgacagttaatatttatatgaaatcaccagtcattttcagggaaaaattatgcagacaccagcctcttaggaaaattatgcaggaaaattataatattttcgatgttagttcccgttgtatggaaaacaagatctaagtacagctagaacagtgcaactgcgcaagttgttttttttttcagcaaggcttgaatggctctcaagagaactaaaatataaaattggaagagggggaagaaggtgcagccaactaactaacttgtgatcatatttaagcacttgtcatgctaccctcacagaagatttagttcctcctctgcctcttctccatctacagaaaactacttgtgctaatcaagttttatcttgtttcttccccatctctttcttcttgttgttcttcagactgaacttagtctgaagattcagaaataaagtgtgattttcaaagctttgctagttgcaaacgagacactagctttggagtttggaggtaagctgctgtgctttccttttgccatatgcgattcaaaatatatgagtctgtagcacccaagctaatttttttcttcacattggtaatgaacattgtcattcatgatgtagggagatcttgcttgtggagaaactcacaaatggcgataaagatgaagggaatattcaaaggcctgaagataatctctcaaatgttcggtaatactcctatctttctttgtttccctatatctctgcctgcttacattacttaagcttgcattttgttgattctggtttataaatccagattcagattcaagaaaatgtagtaaaagcacaataagatagtactgtgtgtataaccgtgagaaatcacagaaagtgatcaatgtacaacaataagtttataacacatggtttctttttcttttgcagtgcataaggagcatgagatggaaattgggtaccctacagatgtaaagcatgtggctcacataggtttgggcaccagtgacacatctccaagctgggtaaacataccaatacttgacagccttttcatcagatgatcaactactgcattatgatttatgaatgttttctgtttatgagttttgcttcatattctagtatttctaattattggaaatgtacatttctcactttcagatgaacgaattcacgggaacagaagatttatcaaccggttctctgagcacaactgcaccatcaaggcagacttcttgggcctctttaggtatttaatgtcctctcatctttctatgtttatccttcaaaaataaagtcaatacaacatatataaaggttaatcaaacaaaagattctaaaatatgaagttccattggtgcttttgaatatgccacttgagccatgcctgatataaaacgtcacaatcatccatagtagtctaattggtcctgaatcttcagaactaatcatttattactatataaacgttggaaatcttcttgatctattttctaaggacaagtacttcagtagtggcacaccacttacaccattttctttttaggttgcttgcatgtttacaaggtgcaatgaacagatatacagaaaaatcatcaaacatggtatccaaacattcatgatgaccaaataatattttttatgcagattttgaacagccaagaagcatgctgccaattgagatcttgccggagaaatctggccaggaggcaccctcctgccctgacatcccaagaggcccaaggaaggtgagaaggaagaagaccagaacatcatcacctacctcatctgcaagatcatcgtcctcgaggtcaagaacctcgttcgcaaccgcatacgacgcattcaacgaatcgcaaagagggtttcgggttgcctgaaatttacagattgtgtttgaaactaccatgaattgtacattgtatgtcggtataggaagagaattgattgtgaattgtttgattctttctttttctttcttttcttttacagtcaagacatagttggaaatgcaaaggaaaatggattaacttaatgtttgaagttgtgtgcatctcaaattttatacttctgactaattcttcagattcttttaatgattggatggcagtcggcagatgttagacttcagtagtataatattttttccccacttcagattgtggattaaaaaaaaagttttctaacatttttcaataacatatcaatataagtaagcttgattcacatcatttttttctgaaacacatacagctgtgagggggctaataatgccattgatcacgacatgcaaggaccaagaacaattcgactaactttttttctacgccaagttgccaattgccaagacaaacgtgcaattgacatgatgcaacgtttcatcatgcctcagcactttgttcaaggactgtaataatgtgatacacagctgatctaatcatataaaaaaaacacttggaaatatcatcaatctttatatctcgtgattatgcactgcactctgctttccttgcatttgggcaaagcataacctgagcatcaagggcaagaaccttttgctacctatgcaaccttacaaaaaaaaagaaactttttgggagtaaattaatcccatttttaccctgacataactattcaggtcttttgcgttgatcaacttaacctgaccgtgagtgcaatgctaagagcaaagtcatggccctgcgttgaccgacgtatcacgctgtgccacgtgtactaactaaccacatgagagtgatttgacccaaacaatcactacattggaaaatgacttttttttttccatgtaccatggactgactcacaagccatgaatattccagtgtcacctggctagtcttgagctctgctgtgaatgtcaggtaggcaaccatggcattgcaacaagcacaagagacagacaagaacacaagatggaagtaaaggtgaggtgtcatatgctttggaagctaatctcaaggtgtccatggaaagcaaagtacaccacagcttgtaaagctcccagccattgaggcctacaaatacccggctacctagcttggcctcttctcatccaccacaagaagtgaaaagcttcactgagcttgatcaattactactagttaattacctatagctaagtagtaaaaaaaaaactagctggttttggtttttgttgcagtgatcaatggtgaaaggtactagtggttacagctatggccttgggcttgcctgctttgctcttgtggttgccatggctggagctactcagctcaaggtcggcggcggcaatggctggagcgtcccggccgccaatgcggagtcgtacaacgattgggccgagaagatgaggttccagatcggagacaccctaggtaatcaattgattaaattcgagttctttgcgacaaatattattccatgcatttgtgatgaagcttttgaggtactagctctgtttaatgttacgagtcgttttgactttttttttaaaaaaattacaacctctttagcttcatcaagtttacagaaaaatatattaatattttcaacatataacaaataaaaactattaaacatattcaatggtagagttaataagactaatttagtgttataaatctatattttttctataaatttaattaaactttcaataaactggactttagaaaaatcaaagcgacttataataaaggaagtagcgcatgatcatggcggatcatcatctatggacaatggttgcagtgttcgtgtacccgaaggacaaggactcggtgttggtggtggagccggccgactacaacgcgtgcaacacgtcgtcgttcgaccagaagttcgccgacggcaacacggtcttcacgctcgaccgcgccggcgccttcttcttcatcagcggcgtcgacgccaactgccgcgccggcgagaagctcatcgtcatggtcctcgccagccgcaacggcaccgccaccgccaccgcgccgtctccgcccccggcttcgtcgaccgcgccgccgccgacgtcgcctgcacccgccagcccgccgccgtcgtccccgtcacctccgcccgcttcaccgccgtctcccagctcgtcgggcgccgctgctccgacgacgccgccgcccgcgtcgtcgcctccctccactccgacgccagcgtcgcctgcgccatccgcgtcgtccccgccggcgccgccatcggcgaacgcgccgagcgcgcagggggcgaggaacccgagcgccacgtcgtcgccgccgcccgccgcgaacggcgccgcgcacgccgcggtggcggcatcgggcctcgccgccggcatcattggctacgccatgctcgcactctgaagtctgaccatgcaatcagtgcaaaagtgaagctgttgtaataacttgaattaatttggagggagatgatttgtgtactatacgtgtgtgtgtatgtacatcgtgtgtttgtattaattcgttttccaaaggatgaataagaacaaaatgatatcgagcatttgtgccaaaatttgatgtgttcaaatccaaatattaacccttgtttttttatttgaaattcgtcgccggctgaagtgcaggcaacacggcgcgtttcagccgacgggggcgggtacggggattcaatctccgatcccggataaatcgttgggctgggccggcccagttgtactttccagcccgtttgtgaaccgttagatggtcgaatccatgacctcatgcctaacaacaaactcttccagtttatgaaccgtcgttagatggtcgaacccatgacctcatgcctaacgacaaactcttttcagtttaaatgtcaaaaaacaaactcctttcagtttatgaaccgttagatcatgtggagattcgtgcaggagtctgcatatggctggggtcgacccacgacattatgcctaaagacaagctgcattaaccagtgagcctcgtgcggatttttctgttgattttatagcagttacatataggttagttatagtaacaatatactccctccgtttcgagaaatatttgacaccgttgactttttagcacatatttgaccattcgtcttattcaaaaaatttaagtaattattaattcttttcttatcatttgattcattgttaaatatatttttatgtaggcatataattttacatatttcacaaaagtttttgaataagacgaacggtcaaacatgtgctaaaaaatcagcggtgtcaaacattttgaaatggagggagtagttaaaacggacatacactccaattatactacagctacatttaactttgcatttgaaagttcttcataaaaaaattgttgaatgttgtacaggtactcccaattaaaaaatcatcaagaggtcctttgaaaagagtgatttaggttgtgttagagaggaggggttgggaacgccgaacaccacctctccagtatgcaaaacgaagcacacattagcatataattaactataagtattaattaaaaaacttaaaaatgaattaatatgattttttaaagaaacttttctatacatttttaacagtttgaaaagtttatgcgcgaaaaatgagagaggtgaagttgggaacattaacttaagaacataacttttctttttggggaatacagttaagaacacaacttatatgggaaataaatcagctcatgtaaaaatagtttcaaatttctatcctttcatccgaaaatataagcatttatatagtttttcacgtgggttaacgagaggagtgaaattaaacgagaatggccggttgagatggaaaagttggtagagaaattcaataactgatgactgtgaatgattgatacgatgtagtaggtgaagatcttataatctaggataaattttaaatgctacaaaccattgtatcttggaactgatgcaacgcaattgcacgccaactaacgagctgattttctaataaacaagtaaatcatccatcatcgttcacccgcatttcatctacttcaatctacattgttccacccaaattcaaacgtaacttatgatctctcaaatcaaacaggtattatagtttctggtgtttctctgctaataaatcaggatcagactaaaatgatctcacatctttaaaaaataaaataaaaaagagaggcctcctcctgctctctcccgacaaatgacattggctgtcaggcagcctgtgcccaaatcaagaatcatattccggtaaaattatccagcttagccccgagtattattctgtccaactttccaagctcgatcggcaaagcatcgattcgaaaggcgacgcagttgacgcgatcgacgggataaacacagcatgaaaagcgatcgagagcccccagcacatgcccctgcatgcctgcacgcccgagcaaaacgttagcttcagcaaggcaccgtgtggcctacagcttgtaaagcctctccccgatcgatacgcctacaaatacacgcgagaaacctgcaacctgacgaaaccatcaccaaaattcaggcatctatcgacagaagcaagatcaggttagtttgttcgttgtgcatggcagcaatggcgagcagctgcagtgtgcttgttgtggcctgcagcttcgctgtgcttcacgtcgtcgccatcgccggcgcgacgcagtacaaggtcggcggcgacggcggatggggcgtgcccggcgccggcgacgagccgtacaacacctgggccgagaagaccagcttccaggtcggcgaccagctttgtaagtatatttacagttagctgctttaagattcagccgttattatttttcgagtgcacggcagatacatactatatacacatagtgaggtgagaatcatcaactataatgtcatcatcattacagtcactagtatataggttctactcttttattgtcccacatgtcggtgtctataataataatgtcattatgatagagaatatgaactcataaggacagacccagccctcggcccctaggtcatggcccggaggcctatggctgaacacccatgtaccttttttttttttgcaccatgatgataaaaaattcagtacacgtgcaacattacagtcacacttttgagtctatagcatatgcgcactgacacataccacaacacacgtaacatcacacttacacaccatgaatgtaccgatcttattgcgacatgttaataagcattttttttaatgtgtatgctagtgttcgtgtacccgaaggacaaggactcggtgttggtggtggagccggcggactacaacgcgtgcaacacggcgtcgtacgacagcaagttcgccgacggcaacacggcggtcacgctcgaccgcgccggcgccttcttcttcatcagcggcgtcgacgccaactgccgcgccggcgagaagctcatcgtcatggtcgccaacgccaccgggagcagcgcttcgccgccgtcctcctcgtcgtcgccgtcgtctccctccggtggtggtggtggcggtggcgctccagccgggcaggcgccgccgggtgctccggccacgccggcggggacgaacagctcgccggctaacggcggggcggccggcggcggcgcgaagagtggcgctgggctcacggtggcggcgagcggcctcgccggctctctgatcgccgccattgcctgcgtcgcgattgctatctgaatatctgacactttgcaagagaagatgccgtttattcgtttattcagaaagtgaattcttctgttcgtttgatgtaaaggcaatgtaccttttagtttgtactacttgttattttcccttgtattgtatctttgttttttcagacaaaccattataaactgaagacatgcaattctaacatgggaggacctaaaaaaactgccacaagtttttggaataaaaaactttcggatataattaaagtgtaattacgttgtaagtacattataactacactataacttatataaaacttgcatttgcatttgcctatggtttggttagttagcattgagatatcttacacatgacacttgtgaaaatttccaatatctttgtccttggatagcggcagatgtaaaagaactaaacttctataagaagttaaataatgagaaactttacagaacattttcacagcatatatggtcatcgagcgcctattctagccccagaacaaaggtaggatgcacgagttttaggtagcttaggtaggatgacaaacacggctagcttaggtaggatgcacgagttttaggacctcagagagaatgaatcacctcctaatgctagcttaggaatgactagttctagtacttcatataaaatgaaaaggaaatgctattcttctgttgacagaaaatgcagtgccaaatggatcaaaattcaactttgcagtatatcgccagaggccacacccacatcgtaacatgtagaaagcatgcgcagatagcataagacaatccaaccatattataaggaaccacgaaggtacacatattgggtttgttaagcatgaaaactggaaatttccttgaaccaaaacatagcagccgaattaacttgacagtcaacaattcaggacactgagcaaaactaaatctctcttcaggaacattgggagctatgagactatccaaagaagagatgctccatggcgacaagttggctgacaatacatctacagcctccttcctctcctacctccctttctgcgggtgctgtccgtgggaaccggggtcacatcctctgcaaaaaggatcagacatacaatcatcacaatgtctaaggaggattgaagcataatgagcctgctacaaacactatccacagcatagatgaaacaaataactatctctatatccttaggttgtatgagtgaaactctgaatttaccaatgcgaccaatcttcatgccagagcgagcaagagccctaagagcagattgagcaccaggaccaggtgtctttgtcttgttgcctccagtggcacgaagcttgatgtgcagagcagtaataccaagctcctggaaatgttcaacagaattttaaaaatacttttaaaaagtcactcaagaactgtccatctgtccaattgagagataatgtttccatacaaaccttgcaacgctgtgcaacatcttgagaagcaagcatagctgcatatggtgatgactcatcacggtcagctttgaccttcatgccacctgcaagaattcagggaatggtcaatttacctcatcagtaattgcagctagagaaccaaatgaaataaataaacacaaatcataccagtaatgcgaacaagagtttcccttccagacaagtcagtgacatgctgcagaggaaaacattggtaagaaactgaataggtggttagactagattgaaggatatatataactggaaaaagaagtacttacaatgaaagtgtcattgaaggatgcgaagatgtgggcaactccgaacacatactctccttcacggacagtgggtccaagagtgacgttctcctccttgggctccctggtcttcctcttcgactggaggacgagtaacagttaagctatggaatgagaaggaaccagctacagctacataacaattacatttctacatgccaagttgtgacaaaactaatttatgccataacctgccatacaagtaggtgtgcacagtacactaagaaattttcatgcctctcatcaagtaaacacagagaccttcctacatcatccaaatgttcactacaaaacatacttggagtatctatcaaaaacagtgaaacacccttgcaacaattacatttctaaacatcatcaacacaaaccagaccttgttcaacacaaaactgcgaatcaaacgccacaccaatcatgtgctagggtcatacacgacccaaaattagaacagcaaatcagtgaaacacccttgcaacaactaaacaaccatttggccatcacatcccagaattgatacaaaccctgtaataataatctccctaacatgccagatgctctagtactaagttacagctctacaaagccaactcgcagaccgtgcgtgctacacaaacctagcatcaaagctgcaaatccgggcaggaatttgacccgagatggggaacagggggggactttggccttaccatggtgggacgaggcggcggagatcgaggcgagcgccggtttcctcctggtcgttgagatcacgagctcgccgccgccggagacacgagagaagagggaagggtggagcagcgagtgagctttatatatgggcgcggcggcgcgggggctagggtttgctgcggaagcagcggtgtccaactctcccgctgcaagtgggaccaggagtgttatgggctgggccaagatgttgtggacggcaattgacggcccaggttagcccatgctgtaggggcggatgggccaaacaagcagagaataattgggccggtcaatgtgtgcgctattttttgaacaaaaatttcatagagccacatctttacaccgataccaaaatttgaatctgaaacataattttgacgttgattttaaggtttttcatagtttttttaaccttgatgtttaagtcattaaaaataaatatgtaaatgtttaaccataatttttttatcagtaatgtaccgttgatgtatttactagcaattggccaaccatgcaacgatagcctcacgaatgattttagctgaatatgttatttacattctcagcaatcactataagatatacatatgtttaaccgtttgttttatttttttttctaaaaaagaacacgtagctatcattttgtctcattgcgagttgatttattattaaatatacttaaaacatgacctacattttttttcatatttacccaactatcgacgtacgtccaaaaggcaataatatcatctataaaaatcacttgtctcgctgttaaatagtcaccgtatatgtctgtgtcgtgtcgttgtcactgtgtggtgaatatatggtgatggatggaaaccaaaatgctctttcctcgtgtacgacggtgtacacgagtacgtcgccttcgtgcatgtgtgcccggcagttcacggcatcgcgtcgcaatcgcagccgtttgctccacaccacacaacacacattgtacggcgttgctccgtgcgtagcttaggtaacctaccctgggcggccggagcccgcctccaccgggcgccggacacgtcgccccggccggcgccgtcgccgtcgcggcgctcattaaaccgaaaaggcgccgccgcgcgccgcccactagctcgctggggagacgccgacgtgcgcgcgcgtgtcgcgcgctcacgcggcgcgggcgcgcgggcggcattaactccgccgttgaacgctagcgcgtcgcgtcgcggcatggcgcgccaacggacgccagccatgtgtgtgtcttgtccgcgtacgtgcgcgccgctggtgtcgcacagttgtgtgatccctatctcaccgtagcgtatgaactgtatgtacagtagctacctgctactagctctgtataaatacatgtactgcctcaagctgggcactgtaaaaccgtgcacacttaagcccacaaaaatcacaagctctcgcagtgtcactagccactagtgtgaggttacaaaccaaagtttttttttagttgtgtcatggcgaaggcgcaggcggcggcgaggatcatgacggaggtggcgccgccgcagctggtgtcggtgatgcggcggaggaagcaggtggcgaggagcctcgacacgatcgccgaggacgacagggagctgatgcaccaggtgccctacgccggcgacggccaccaccacggcgtcaagaagcaggctgcagcgaccagctcggcgagcaccttcgccacgccgacgttggccttcgagcggcagccaccgccggcgccggcgccggcgccggcgagcgggttcatgagggggctcagcaagtggttctccaacaacggcgtccacggccaggaggggtggccggagatcggccgcgaaggtcaccggcgagccatctattcacagcaggcgcacatacgtgggcgcgccacgggattgaattcaagttcattaactagctagtcgagtttagtacgtttatcaagatgagatgtacccaagtacccatatgcttagttatgatgaattacggcttaaaacaattttgtctccttgacaataataatatttgcaagacatagttgtcctctgaaacaaggtatgaactgttacgtaccaacaagtcagcatggtagagatgtgtactgtcaatctgtcacagcctagtatgtctctgtagtggtcaagggaacataaccaagggagatgcgtgccttttattttactatcacttggaacatgagcttccatgtacaatgttcagttcttaattacactgcactagcatctaatacgcacctatcgcgaaagaattttgctcacccagccgacctagtaacaacaccggagagacattatgttacactcaaatgccctaacgtgagcaactagcggtcgagcaccaatgcaaaactatgatgcatcggaagcgtctatgaagtgaggatattcgtatttaagttttttgtcctgaatcaaatgaaaaacatattgtaccactagtttgcatcatataattgtggattatcatcagctctcactcctgtttgaatctatctcctccatatgatatgtatgtacaggtatacaagagtaacaaactgttctctcttacatttactgctgataacctgcatagttcaaaatagaacaatcagtattatagtaaaaaatcatggcaaagtacagttaccacatacaatttgtttggcaatagaaggaaaaggatgcatacaccagtgatatgagggcttctgtagtatactaatgaacattgccgaatgggcaaatgccagagaaaccaagcttatgacttgaacaaatatcctctcatgctttctccaagcactggattgaagggctgtcaaagagtaaaccaagtcagaggccaaaataagttaaacattccattatccaaatgcattaaacgaaaacctgaagcaccagggaaaaaaaaaaggaaactacaggccaactgcagccgaatatgaaagatgctctcccataaaagctgcaaaaggtttattgcctgtagggatatttggaacttggaagcaaagaaatgggaaggtttttgagaatattactcctgaagaggaaggttggttcagaagtattaaacaggatattctcctgcatttgtgtaggatgaatgagtctcttagcccttcgattctttcctggttacagcagttgtagttttgttttgctttctttgttggtttgtaaatatttcctctactaggcaaggcctggtagtattttcctttaaaaaaaagctgtaaaagtaagagaaggcaccatctagctacagggagaacaacatgtagaacagactaatgaagagcaggaagctgcaattaaatctaaaagctaatgatgcagtttagacatcctggaaatttgggatgaaaacaaaaagaatggtagaaaacatttgacatgatagtggtaagattttcttaagcccctgccattaccctatagctgttgacttgttgtatacaaaattataaaacaaatgaagggctgaccttttgttgctcaaaacatgtagcagcaagctcttgttgatgtttctagctacaccactaaccacccacagaagattttatcttgttccgctgaacagtgccttttcgaattaaagggttttctattgaaaatacaatcaaactgccatccttggttcctgccaagaagcactcctctggagtcacaactagtgaagttatagtcttcccagctccctcatacctccatacaacatcaagagaatgcatagagcgaagaacaatttgtccatgatcaccagcacataccacaaactcaccacaacaacttagttccatgcaattgagacggccattggcttccgaagaagcaatatgttttccatttatggaatacatatgcaaggataggtcactgtcggagtaaaatactagtctgccatgctgcgatgctaccagtttcgacaagccagctcctgatggatgtcgaatggatcgaacatattttccctcacgcaatgtatgaaatatacatgttccatcttttgatccactgataacgatatctagttccgtactaacaaataagcatgtgataatatcatcatggccacataaaatatgataagggctttcgataataacatgatccttagtagacagatcataatttgcatttcttgattttttatcagctgattttcctcggaatgcatgccagatcataacagttgtgtcataacttccggttgcaattacacttccatctgatgaaactgcacagaagtgtgttgacagatgtcaagataaaagcgaaagaaatatcagagatacaaggtttcctgaccaaaataatatatcaaaaatgacaacatatacaattaataaacatcaaattaataattactagctgataacagtaaatatacatgatgctgccagttactaataaaatattatttagcaagctctgctatcatacttaggctgcgtttggttgcaggggttcccaacccctctccctcgtttttcgcgcgcacgcttttcaaactgctaacggtgcattttttgcgaaaagtttttgtacgaaagttgtttaaaaaaatcatattgatccatttttgaaaaaaaattagctaaaacttaattaatcacgcgctaaacgctgcttcattttgcgtgccgggccaaccctcactcctgaacacagccttaatttgctaacagaagttcactaaatagtgagaactacacaaagcaaaagaatggaggtgcaattgctagcacttactgtttagttactaatagtggtttaaggttggagcatgaagagtagatttaatataatatactggattataaatatttacctacctgccacacagctgacaacatctttatgctgccggacgctctgcacaattcttccatcaccaagggaaatgatctgaaaactattctcccaattaccacacagaattaaataattatcaccatgaatttgaactgctgttaggcattgccttccaaaatcaacgttttcggccagggaagtgctaattttacggggagaaattacatcagagccaattccaaagaaaggttcctacaagaataaaacaaattaatgaataaaaactaaatgttatcaaaaaagtactgctatctttgattgtcattaggaagataccagtgatccagaaaacgtgaagtttccaccagactgcaattgtgtagttagccaaagctttactgacagtacaagtccttcgttcatcacaacaatgtttgagtccaacaagctaacaaacaatacaggtgatgaggagctactagagctagggacaacagaagtcactgttatcgattgtggggcaaaatatagtgggtgagcaattggtataggggggcctcttcttgggtgtttcttccggaaaatttgaataggtgtttgtccaaaatttgcaatttggtcctcaatagcagatttctgcaacatatcatccatgttttccaaatcaactgcaccctcgtatgtcaaatagtaaaatatgtttgccgcctggtccaaacaatggctacaccattagtaaggtcatgtagtgtctgcgaggaatgaaaaacttggggggggggggttgggggggggggtgtcggcgctgacaataaaaaaagatttccttttacctcaacagcaggcttgccgcgctgtttataaccaaatatgaggtcaatccagtgatggagattagagcttacatattcactttcaagagcttcgcggttgatatgaatgaattcttctggacaaccctacacaaaagtattgcatactgatatattaccatatgagttataacttttcagctacagatcttagacaatgtattattgaacattttaactgaattgcattagtaaatactacattataaaatatttcttaggactatacttctattacttttacagatacatcaggttaaaatccttgtgctcgaagtttccacttgaatacaatgaaaggtattccccgcaacacacacacacaaagagagagagagagtacaacgagagttaaaaaccagctgatgtaattacgttatgaattgtgataagcataaaatctaccatgatacaatgttatttgaagcaaatggaacacgtttctgaccaaaatttttataactgaagtacaaaaaatttcaaaactatatgaagaccacaggatgcaactcaacagggacataaaccattcttatggatcaaccgtatgctagcagattatgaataaaaactataccggtgctcaatacaggatttttttctgttcctcacccaagaaaaactaataaatatcatgatttaatacatgagcatggatgcttagtacaatcatatgtggaaacagttcgttacctttgcccatggagggagaccaacattgcctaaaggttcaccatcctgctttacaccaaggtgataggaatttgaattttcaagaaactcgggcatataaaagaactcaggtataagctctttgacatcacttgtatttgataagcagttcctatatgtactttcaatgctctgaaaaagacgatctgcgtgatcaaactttccaccctgtacaaacatgtaaaacaacttttaagataacataattttcaagcttgtagaaagacttagaacaaagtaaaaacagtgcaatgtgccaatatatagtgctgagatcgggccagcaaataaagtaaagaaaaacctgcagattgcggtgcagagcagtaaaaggctcaagcctaagaaggtaataaagaacgattcccatgctagagtagtgagatccataataaaaactgcagaaagaaaagagacataagtttgttataaagaaggacgcaagaaaatgtacagtgtatgtttgatcaaagatcaaaccttggtatatcaggatcacagaaattaagatatctttcttcaaaaacctgcatattgaacatcatttattgaacactatcagagggaatgacaataggaagtcacagcaacccatagctcctcatcataccttaaagcgtttggcatccaaggcaccaacgggttttgacaggtcacggaaactggatgacttgttgaaatcaattttctctgacgaatagtcagacaatatccaagggaatataggatattgagttaagtcattgtaagatcgtccagcaagagtgttgagaatcattagatactcaaaattgctcatttctcttcttctccaactttccctagcactctcagccatttcaagggcaacctttctgtcaacaaaagaaataacactgtttttgtctttagtacttcctttggggaacaaagcatcatttctcagggacactaagagagacccaatgtttttagcatcattttgggaggaaaaattaagaaacacaggtgcattggcatcatcaaagaatatctccgttgcagtatattgtagtaggtaccgtgtccaatgaactgcttttatctggcaaacaaggacaaccgggaattaaatttggagtgacacatatcatgtgcttgtggatggttgtgctggtgcatgtgagagtaaatgatagaggacgtaccctgcttattttccaccttctatggtgtttgatgttgtttgatgtatttttcatcagagcatcaccagattcagttgcattgcctcgtcctccgtcaagactacccttcagtttttctgcaccccccaggtcgttcttggggtcagaatctttttcttgatatctgttgaaaacagatgttcctccagtgccctcaaccaaaaattcaaaagaaaaatgcagggctttttgtgtaatagtcaattgtccagcgagttttctctttggggttacaagaacacattgaactgatgacagaatctgggaaaatgagaaaataaggatcccagggaagaagctattaaaaacggtatgtcaattttgcatatacaaaattacagataaagcctacttactgcagcatagtcgtcatctccaccagtagacactggttctttcctattttgaacactagtagaataacctgaagaatctgcagcatcacttgagccctgggtctcagacagggtattctgggaaggctcactcatgtcattgttatcctcgcaaggttcagaactaacatcccctgtaattccacgaactcctttcagaagtaagtgcttcattttttctggaattttggcactaacagaggggttgacagacgaggcattgctttcattactaaatttggatggtggctgacaaaggcgttcatcaaacttatagttacgcttgagtttcagtcgtcgccgccatttatcttctgtcttgtcaagtttccagtacgtcacagtactatttggaaatgggttagcagaccatggtcctctttcctcactcaaagcacgaaaaatatgtatccatttgtcctgatatgcaacataggtcacttcagatgcactgaaaatatatatgtttggtaaaaaaaactctaacagcttactgcaattatttgctgatcctcatcaaatgcaagctggagagctgcttttctactgtcgtccacagaaatggcagcagacttagcaaactgtatgtcatcctcaaagctttgcagttgttctatatcttcaattaagctctcatcaattttggaatgaagttcctggagctgcctcaggcgatcagcctttgcatccttcatgtatttgacctcatcagcagcctgaaaagcaccaaacatattgttcagccgtagtgtcttttgtgcactgttcacaaaacagacccaaaaaataatagccttcagggttcagtagcaaaattttactcctggtaaaataaagaaaagaaatgtggggcacattcaagaatctgtgatatagtaacaatataagaaccatattgtaaacgttttcgaatttttgggaaagcacaaaaggtttgtaatgaaaaacattgacagatacaaaccgcagcaagaacccggtccttctgaacaaaattaagaacataaccagaatccttaagaacataaccagaatccttattgctatttacttcagtggaatcatctcttgccaacatattagtggcaagcagagacttcccttgtacgagaatttcaaaaatcaatggcgacataatatgagaacgggcaccatcatcaagccccccatactgggatctccccctaagtaaagacctgcagaaagaaaagaaaattactaaaacagccaattcacaaacaatgagcaaagtttgcataagtatagccataccaaattaataaatgcagtctatttttgcactgatcatcttctgaaataagattaggaagcaccaatgtgaattgcttaacatacttggataagttttccaagccagctttgcacagatacaaaattataagatggaagatgattcttgggaatctctcgcctcttaacatcatagctttgtcagcattcttgttcgcctttccacttagtgcagaaccaattcctccagttaccactacagcagccatctccgcggccgggatattcagtgattctaccagcccacgtgcccgttgtccaatagatgggacagcagcatttgaaccctttggagtcaatctattttgtcctctgccattcaaattgcaaataagagtccatatcttgtcgtaaaagctccaccaatcatcactcagtttatctccatcagtatatgtactattactccaaggaaagctgcaaaagtgcatatttacatatttgttgatggtaaatacaaattgctcagtaagttataatcttgcatataaccaaaggcaagcaggaaaatataagaaaatagaggctatcatggatgaagacaagctgcttaaactaatactaacatatctgactccaaacggaaacaaaaccaaacaaacttgagaaaagaagttggtgtcaaataatcggtattgaattatctaactaccaacaatatctttccatcagaaagaatactagaatacttaataatgtcaagtgaattagaacacattcctctctcacgcgtattctctctgagcttgttctttctttatgtgcccgtgttacagttgttatgtggcaatatttactgcagtagttactactatattaaccaactcaattacaaaataaaggagctatgacaacagataagacattgttggtatcgtgattaagtttcacacacaattagcatagtacctatgcatcataatggatgacaacaaaccttacctaaaataaaattagtaagttcctaaaatctaaaaattgtacacatggtcacataagatcaattaaccacctaagtatgcacatgtgaagacaatgccattgtccttaaaagaaaatctagcagacaacacacaaatgtctatgtccataaaatcaagaaggtcctaggtgtggtggggtgggtgtatagaactttactagaagtataggcaattctagcacctttaaatattcagaagagttcagtcatgagatgtattaccttgtaagttggccgctaccctcagcatttagtatttcaacaacagaggtgttaatgtcctctattagagagtcatcagatgaagattgtgcagataagccaggtgaaggaaactgttacaaaagagcagaatgagtgaaggcatacataaataaaccatatcttttcttgcttggcacattattcagatcattagcataccaatagtttaattccgatttgatcaacaaacaattcatggataagcttcagaagatacaatatattatcacggcaaggttgcaaaaaaagattttcttcagaagatgtctcaagcaagcttcccacaatgtcttcaaagatgtctcgtatcagacaggaattcggcaactgaccctgtattttggacaatctccataatcacactagggtgggaaaagggcactaaattattaacttgttacagcataaacaaggagattagctttctgacctgctcgattttcaagagaaggaaatttgttgtatcttccagctgatgccagccacctttcatagagcacaagcagtaggtgaggaccaatgaatacatgttcctcacaaggattaactcattggtttcataagtattatcctcagcttctgaacttgatttgtagtccctaaatacatcaagtttcacagatgtctcaagccaagagctccaaccgtactcctgacaaaatcattttattatgaatagataactagtttgtgtagacataagaaaaacggtaactagtaaataccacaagggcttcaacattagaagggtttgaatccagcaaatcaagaagatcactcaagatcttagtccgtgctaacgtgtcttgacaagattgcatatatttaaatatacagaccaaaatctgaggaacagcaaatggagacaagctcgctgaagagatggcactatcttttgacacttcagattgggaacgtttctgtaagacctgaatagaaaatatgatgcaagcatcagatgatccattaatcagttttggttagtatcaagaagcctgatataagaggataaatataagagtactaaatttataaacatgaagttcagcaagttacctgcttaggactggccccaccaagaaggacatcaaagagagtagcacgtaaatgatccgaaagtggaaatttgaaaagtctttcagatattgaatagaagaacagttgaggtgctgctgtcatgcctttccttagattttcagaaatagatctaggccgtcctacaggaaggccaaaaaattttggtccttttttctcagaaggaactccaaccagaagttctccaagaaactgaagtcccaagaggcgaattggctcgaactccctgaaaagcaagtgatttcatacataaatatttttacaaatctaataagaacagaaatactccactctgcatttcagaccgcgactaatatgcacaaacgaagaatgtgagcaaatgaaaacaaaatatggtccagtagacataactcaaatctttcgaaacaattagtcagcgaaattgggacaggtttctatttcaaacagaaaagtgcaaaatgcataacaatggtattacgtgtgataccttactgataagaacaaatagaggacaaaggcaaacatccatagagcagtacaggtgcaatttgatataagaaagtaactatacagtttacaccgtacgtagtataactcaggaaaatactcaaataggaacatggggtcatcttgacctgacccataggcccatgttcatttccatacaatagtctcaaatggaacatcaatttatacccatttcttctttataaaacaaaatatatttgtaacatgcattaaagcccgatggcagcagtgacaacctgacgtgtaaataactgaaagtgcattacctcttaagaagattaatgaagatgtaacagccaccaaggggattcactttctccaagaaagatgataggagtgaattatgtgatagagcacgaataatcatgtgaagtacatcttcaatacatgcaacatcttgacttctctcgaaaaaggacacaagtgtcgttatatcatgttgagaaacctttagcctgcaatagatgattgttgcattacaattaaacaagaaaaagatgagtaaaattgatagcatatgaaacacaagcaaaatactccttgaaaatgaaagcatctatgaatcaacagttggaagtgcttactttatactcatttctgccagactcaataggagcagacggatcttgcgaatttcttctatgtttggcctctctgcaatcacttttttggtaacaggatgcagagaagtcttagaagaccttaaatcagtcttttctgaataaaactggagtacaatgtcaatgatccttgggagcccacacaacattggcaaacatttcccatcgcattcaaaatattgtattagaagcaaataaagttctctctgcacttcatagcttgcatacgcccaaatatgtgggttcagataaatttgtgaaagagcatctttcaatagaacgtctgacatacctgaaaaggcagaaagttagtaatctatactttctaaacatgcagaaagacagatagaaagacagatagctcaccacagttcttcaaaacattaagcatgtacttcaacgacgaaagagtcttaaaatttagcagctgtggtgaaacagattgaaacaagaaccctaatatagagaatccagaaagaagatgcatttgttgctgatttgctacatttccatccaaaacagatgcaacaagctcaacaacttgacctgccaattcatcaccaatggcaggttctctactatgaattacagcatcgtcaaagtggatcagaagagggaaaaatacagagacaccaccaacacaataaattatttcctgcagcaagcgccgggagcataactttgtcccacccatgatagttgcctcaaacttactcttgtcaagaccatcaagtgcagcagatacattgaacaaagttctattgttactagcctggacagaaaaggacaagatattcatttatcttgttcaagaaactaactgaaaaaaaaaacaacactatgcttagagaccaatgtaaacctgtgcattcaagccaaaaatcatcttggatgaaatgccatcctttccatccagaatacccttgtacagagtgtcaacgttcataagcaagttttgatcaccaaggaaagagtacatgtaacttggtcctagattatatatgccttttatttgttccgaagaaagagcatcagaaaatgcatagactgggcccatttgaccaacaaaggcagaagtgctctcaaaaccaagggaagtaggttcttcaccaatgggcatcaaatctgtgccaatactgcagcgagtcattacttcattaacttttgcccacctaaaagcagaaaacgattcaacaaactgtaatcaggaaatcatagagaaaaactaaaacacatggaattaaatcctaatcaaaatatgagttcataagatacccagcgtgcttttttgcaattaagtcatgtttacagataagattcatttgttaggaaaagagaaatgatatttcttgttggagttggtcggtcagagatttgttaggagtcactggctgagatcctacaggtagtctacaatgttactaagttgtagactatcaagttgagtcttgaagacctaatcaggccatgattaattgatttccaagtacaactactcttatatggatggactctcaactttggatgggccaccgtcactaaactctaatggttcatatgctttatgtcccgctccttgtttcattctgtataagatgtatgtgtttggttttgtttgaaattgaaaacattgcatggcatgttcaaacactttttagtcatggttggttgaaacttgagagaagtcgacagatctgttaatttggcaactcaacattatgactcaatcacaatggtgatatatggctttttctttgaaggcaaacaaggaatgggatcaattccctcatccctctcttctctgaatctctcatccttagtcctccaatatctcttaggaatggagcctaagctgcatggggaaaaactggcaaaatgaagtgcaggctcctctcggctattacttcatccataggccgtaactttttttttttgacgattaaacagcaggagaggctcctactgcgctatattaaaaaaaaaagggggaaagtatgtacaaggagagcatatacaaaggaaagagagcaagaaaaagaaacaaaataaaattacaaatcctccaaattagctaaggctttcagaaaactgaacaaggaattgaatagtatcggaaatcctgtagcatgattaaaagtttgaaatagaaaattctgacgaatcacatccggtataccaaacaaatgaagaatctactcacctgcatttttgattagatatctggccaccatcaacatagcatctcagctggcttccagtagagaatgctctccctactgaatgagtaacagaaaggaatatccattgctttgttgggaggcttagaggcgacaaaacacactgatgtttttgactgatagactgcatagggtaaggatagggaggtcaaattaacatatattacttccgtcccaaaataagttcatttttcacccgccacacacataccaatacaaaagcaaaaggatagaatacccctactttataaaatcccaatacaactatccatcactttacccaatacaattattccctacttttacaaacttcgatgcaatgattactctaaaaatgaacttagtttgggacaaatggaagaagctaaaaatgaacttaatatgggacggaggaagtagaaaccaaaatcgaacaaaaaaaatgataaatgaaatcaagtgctgcatccagttcatggcatgtaagcatagctgtgtaaaacgggaacttattaaaaaaagactacaaaattctaattgtctttctattgtccactaaataatgattatcgacagcacatcacctaataataagagcagagcacctaacagtaagggcaaacaggaacgcatggccataatctaataagtttaagaatggtttaacttcaagcattagctgcaagacattgtaagatattaatcagtgaaacttgggacatttcatcaaattgtttgcaattcttaacaaaatttcacatggaaatgtaagtcagtcagtatgttgcattcccaaaattatgttgctagcttcgctagtgccaaataaccatcttgacaaattaatcttttaatcatttgtgctataattttctcattcggttaggtagtacatactccctctgtcccgaaaaaaacgaatctaggattggatgtgacatattctaggataacgaatctggacagagatatgtccagattcgtagtactaggatgtgtcacatccagtactaggttggttttttatgagacggagagagtagtagtcaatgaaaaagaatatttaatgacttgtaagtgttcttttttctgaaaattactaaaatgagctgatggctccaaccaccattacctcaaatattagagcatctttcccaagcatagccaaacatccttttccactttccgtgaaaaaggagaaaagccccatcatgctattctcaaggaaactttccacccttaaccagcagcaaaaggataagcccttattgtaaggccattgaacaggtgattttatttcaatgccctggtaaatggaaaaacaagtaggatatcagataatcaccagataaacatttcctaatggaggaaacaatagaggtacttgtcctgcagagtctatttgagacaatgagaacgactagtgtaaccttgttcctaaaaaaacttgcaacaaaatggaaaatagagaaatgaaatgaaaaacagatcatttaaagagttacaaactcaaaaattatgcccagtcaaaaaaaaatgaaaatagtactaaacatgaaaataaaaactcacagagtcatgaccactaaattcaaagaaagcttcaggtcccttttccttgagcatgtgactaagacttgtcaaaagcaatgaattacgcttctgcttgacaccaatcttctcatcacgcaggagggcaaacatttttcgtatatctttcccgcaaatactgtgcccaccaataatctgaatcaactcggcaatttttatgacagtatcatcagtttcctctactgaaaaccaatcaagaagaaaactaagaaatcctgctttgaaacaagaacttctatttgtaatggatcccttgagcaactgttgtaggaccacaagcccataatgctggagtgcagtgctgctctgccaattagaaatcgccaatgttgcgtatcaccaaaacatggatgtccaaccacaaatatgtgcacacatcacagggagtgcgaccaagagagagacgtaccttttgtaaaacatttaaaaatagtatgatcacatcttcattctgagagaaaaaaaagaaaggtaacatcagataacagaaccaaatagaaatgtgggtacaatagagtgaatcacttgattaagcaagaatagcattgcttcaaagatcatgaagattacttgcctttattgtggtttcttcgtttttatcaaatgtcccatcaacaagcatgccaagtatggcatccaagagtttctgactaggtaaccatttacagaagtccaacagcaagctttgcagtgtttgataacccacgccaaccagcattctaaaggaagcctggataagaaaagacagagttttagatgcacataaaaaaaagatgatcagaggagaaacgaatataaagtccaaataatgcttgccagaaatccaggtgacagacaggacggcaaatccagaaacaaatgatactttggttctatattttcgcaatgaaaagagcatacaactactggaaaacaattctgatatttaacttgctagatgctctggtttcacaagaatatgcaggttccacaacaaatgtgaccttggagattgagttgaaaaccctaaacgggagtgaacaaagaaacagcagtactaatggttacatctcgaaatgactcaaaaccaatactggcagcagtctaatggttccaaaaaaattttctcagacacggaggagagctgcctatcattatattaagaagaagaaaggagagggtaataacccttacaacacacacataaaccttacatgagacaaaaagaccaaaacacacacataaaccttaatggttccaaaatagtacaaaatgtaaaagtgtagagaaatatttgattacctttgacacatcattttcagcaagtaatacagtcaacgtctgaaggacattaaggactaattgttcaccaactgcttcatcaaaagtcccattcagtaaggatacaatatgcaggaagcactccccattgcggaacagattttgataatactagaaaaaggtatgagtgaaaagatgcatttgtcagggatgatgtgatattaatgaaaaggacaaaagaacattatttaatgggaataatcccatcttacaaaaagaataccatgcgatctatcataatgatctctctcatgttaactaatagatcaatagacaattctgcgaagtcctccttttcttttgcacgagtgaaagcctccaaatattttgaacatagctgcaactttgctgtatgatcttgtgctgatgctgaaggtaactgattgtgagaaaaggagatagttttagttccaaagaaatcatatcacaagcaacagaaggagagacaaggagcacggcaataccctaaataagtcaagaacttgctccaatacattttttcggaggttttcttcttggaataaatcaaataaacactcaatacaattggcattatgtaaaactagaatctttccaagctcagatattgtggtgtattccttgaaaagattgaaagccaattccacacatgcaatagtacttttaatcttctcatctgaagaagacatctgaacattttctgattgaaaaacatttccacttaagccatctccgggatgggaaagcttccttagatgttgtgcttgaagacatgcaaccttcaggactctggtaagcgcgtccaatgatttaaaggaggatatagtctgttcagtggcaagttgcaggataacatgaaaactcttaagaatagttccagctaatccaggatcataagtgcaacgttcaagcacatctaataacgctgagcactctggctacaaacaaaagtaaattattttaataaggtgaataaaaatagaatggcaaaattcaaattatgaacaatgcgcaacatcttaggtgacgcagcagaaatttaggataccagattgtttgtgttctcatttattgttgcggcaaactccaagaaggaaatagcttctgcttgaagaatgttgacatcagcttgattaaggcctttagaaccagctgattcagtagcatcaataaaatgattgttttgtgtgtcacaaacaatatgatgaatatactccatagatgatccaaagtaaaaaaatttatctgaaaatatcagactccataaaccctcagcgcgaaaagatttgagcagagctggtactgaaatgagaaccttcctgaatgtgcaaagaatataatgctgtagggtatttgccaaaatcctggagaatttagtcaatacaaacaaaaaaagtcagcaaaagaaatttagaaatgaatgatggcattaaaatacataaacatgcaattacttgaaaaaaattacaaaacatgatacttccacacacagattcattgcactcatgaaacaagacggtagccttgcaatcatcaaattaacaaattgtacatgattagatagatattaggatcaacaccattttagacaattgttcacatgttgtatctagcagaatattttaattatcatccattgagttttgcagtactggctatacatcggaaagactaatatattatatgaagtcccctgtaccatctagatattcaggaaacattgaaagcaaagtccacaatcaattcatctagtctaatcaagaaagatggacagcaacattaaggaaatgagaacctaccttatatggttgggcaattcagattcactagcacaagctttgatgcatggaaaaactgttgaaagaacctttataatccatcttgcacattgctcacagtatgccactgagatggacagagaaacttggctatcaactgcaccagaagagttccttatctcgttaggaggaagaagaaaagaacaaagtgctatgctcagctttacagaatactcagtccattcagttgtatcaagaatatcaataggacttgcaaaagattctgatgtaagcgatatcccagtgctttcttcaagcttacagttctgcactcgagagtcaagtgccttttgttgatgaaacccctgaagcataaatgcaggccaacagatgctgtttgcaaacttatgtatccgtccattttcacataagaactgtaaattgttgacattaccaaaactgaataggaagtcaaggatccatagagccaaactatgcaatagcatatggagtctaacttaaacagactattaaattctggataagtaggtattagtgatatattcatttatttgcagccagaatattcaaggtgcaagagtatatcatcgctccaagaagacagaatccagaaaaaaatgtccagtcatgtatataggtgtgttatagacatgaaacagttaaagtccacctgtaacaactagtttgtacttaatatattgttaataaattatgaaagctaaaaatattttttatggtttcagaatacatcgtatattcaattaatgttcagaggtatttctagtcttttttagaaaaaatggatactgcaagaatccagaaataagacgtttcattgactgagagtaacaaaggtgtacaggaaaattcatgcattctcttactaaaaaatatatgtgcatcaggatacactgcctccctcagaatttccagcgataatatctggagctgtagaattccactcctgtgtaagacatgttatggtcaaatcacacaaattatatatagaaagcacacaaacctcctgcattcctgcacctaaggtttagtattgccacagttgaagcacttacctttcatcactggggacaaaagaatactttgagactgacaatttgcttgatggtaatcccagtccatctaatagaacctccagtcctccaatgcttctgaaatgattctgtgcacgtgcatgttgagagattgttgatctcagagcatgcaaagttataaagtgaagtagcacgtcagtccactgctctttcaaattcaatcttcggatgacccttaagagttctgcaagaacaattccagatcagtaagataataacagtgcaaaacatgaactaaccaatttaacatcataaatcctgaagaattaattgtgttatttttctccttttgcaataccacaggatgcataaagaactaaactatatctagacaagtacaattttggagaatgctatgacaatccatgtcttatgtttcttaggctgtgttctttccccctctttcccaactcacctctctcattttccacgcacacgcttcccaaactactagacgatatgttttttgtaaaagtttttatagaaaagtttctttaaaaaatcatatcgatccattttttaaaaatattagcaaagttataaagtgcttcaacactccaaaagctttggtgtctcgcatgggcttctgcactccaaaagcttctcagtggatcagcaaactcgggcagctagcacttcccagtgtgggctgggttgtgtgcgtgtgtgtctcggtgggagggccttggtctctcctttgttttcttctccttaatgaaatgaaacgcagttctcttgcgttttcgagaaaaaaaaattagctaatactacctccgtcccaaaatgtagctaatttctacagtaacttgtcccaaaatgaagctatttctccacctaccctctcctctcaaccaatcacaaccatgctcttcaccaactttctcttctccaccaatcacaacccttctccaatcatctctacctactttcttaatatccgtgtctaccaatgcttacattctgggacagaggaagtactcaattaaccatgcgctaatgagtcgctccattttgcgtgcatgggagattagctcccaacaccatctaaagaacacagccttagtggagggagcataaatccaacacaggaatgatacaaaataaaatgtgttttgtctcatcaccctgaatcgtgcaaaacatttttattgccatcatgaaaattcagttactgaaagttttgctctatttaaaaaatagcaaggtagcatgaataaatataactatatatgtggagtatttactaagcatttgactccataaatgaaagtaaatataactatatatgtggagtatttactaagcatttgactccataaattatatttcattcatttgatttgagactgcgcaaaaataatttactgcagcaaagattatgcagcgtaatcatctagcttcagcatacttgttccatttcttattactggcactcttaaccaaatcatgcacactaacttagaaaggaagcaatggtttgaaggttggaccaaaataataccataagcacaaacagtatgtataaaatgtaaagtagaagatggtggatgaagtttgcaagtgtaaatttggaataacatctcaggacttttaaaggtccaagtagttggggataatatattggtaaaaatgcagagctgtttctctacattcagtgctggaccacaagctagcaagattccttccaaaaacacatcacactaatgcatcagcaaggtttacgccctctcttatcacccttttggccccaaattacattgagcatgccaggatcattcatctcatgtcgtaatctcttccactctttggtttcagaccagaacatacaggtcattgtcaacttgtctctgaatctagaaccaaactatttgtgtaaactggagttatggagtatggatcatgcttactataagagtttatcaataagctagttagcattacagattaagttcaattgtcctaagcaagtgtcaaaaaagaacaatgttatcagatgtatacaaacattgagaaaacaatcctacctactaaccaattgacgcctccagcttccataactgcaacaatggccttttgctgccagttggtatcatgaacagcgctttttgcagatattggagtaactgtggccaaaaactcatttgatagggttttcccagtagtattgacaaattgcgttaacctagtagcagttggctccaagttcatgaagtttgaaattattgtaacaatgtgtacaagtatcttttgcatcatcttcatgttatctatggctttgtttgacagctgttcatctgcggcaagcaaactggtcaaagtcttgagctttacaactgcagctgaatacacaagagaaaaaacgtcagttaagaatagattcatcacaaaagaaaccataccagtattaccacggacatcacaacctaagctacaacagtgaaaatggtatgaaacaaaaaaggggaaatgagcgaaattacttctagaaaggtaaaacactactaaagaaagtattgtacctttcagaagagcagtgaccttctgcacacctccataataactaaatactctacagttatgcactgagcgagtaacaatggtcaagcattccaaaatattcaatccctcagagcttaacatcaggtctgacgattgttctgaaatgttaggagaggattccgaacagctgctgcctactaatacgagaaaaacaagtcatatatcaattattgctggctcactctagttgcaatactttacaaccactgaacaaatcaactactatcatgcatagcctgattgctcatttttcctttagcaggtactatgaatctatgatcttgctttccgagaagacatgtaactgattttacatcagtgtaaatttaaaactgtcatagcatttagatatgacttctgcaattttgataagtcaaatctggcaaaagcatgtttcaaatctttcgtatgcaaagcacctcttcaagcagatgtttcgaatctttcagtatgcaaagctgttatgactgacatattaatggcatcttaaaatgatatggaattaatggtggggtgcaaactacaaaagttgtatgctatgatatataaaaagcagaaatgaaaccatgaaaaggagggaatgcatcatcaagaaaggcatcatggtgttcatcagatccacttactctcagtaatgaaagaagttatttgagaaacctcctgcacaagaataaggatgatctcagaaggatgccctctggagcatcctaaaaccgtatcatctgatattggttcttgatcaactgattgctccgtgtattgcggttcccactctttgaatgcttgtacgaaatgcatgataaatatttgcaaggattccttcttttcagcctatggaattgttggcaacagaaatgaggaagcatgatcacaaacttttggggaaaaaagtacagtttatgccataaaaaatactacagaatgaaataatgccatactacagcataaaaatgtgacattgtttccttaaactaagctatatgtagtctaaattagtcgatacattcataatcttggtcatcgtatctcatagacaggagcgttgatgaggaaactagtcaaagtaatcaatcaaatcattcctcaacttcaacaaagccatctcataagtcataagtaaaaagtgtaaaacaaatatctgttattggcatatcatgtcatgcaaaaatcaggaaattatgttgtaatgttaatgcacatgtgcttgatacaagctgtttttgacatcatgatcaaaggaaatagccgaagaaaaggttggtggcaaaccagcatgcaagattactcaccttgtcaatggcattctcatatttctgccaaagcatgtttaagactccttcaacaccactatcactggaagcagatataaacattgttagaacttacaagagaatcagccttagcagattgtcccctaacaactataaaaactgatgttacatttgattaagatgtaatgttaacatgattgacaaataagtatctacagaacttagttgcctatcaacattataaaatcatcatttactcttttttaacaaaaaaaatcagtatattaagtgcaaaaccagggtaatcaactctagtacctaattttggcacagattttgtgtgtctatagtggaatatcacacacgagctacttatactgttcagtgatgtaactatgcgtatgcggactactgaaatggaaaaggataactaaaacaaccaacgtaccaacaacatacctcttatcaattatccgagttaacagttagcgtgcacagttacttaaccaaataagcagcaaaatctaccgcacggaagcaagcttgagaatgcagcattggttcgtactcggtatccagtagagcgcacgcaccaacacattgagctacacaagcaagtcgcattccgcagagcgagcggtttcctgaggatttgagtcggctaggttacctgaagcggaccctgggggacggcgcggcggggagcctgtcgggagcggaggaggaggagccaccggcgccggcgccgccgccgccgccgccgtcgccgccccctccacccccgccgccgccgccgccaacccccgacgaggccgccgccgacttgcggaggagatcggcgacgcccttcacgatgttcatcgcccccgatccgaggcggctagcagcagcgcatcaccgcgcggcggcgggcgccccccgcgggggaaggcgacgaggccaccacggggattcgattcgaatccaatccccctctcctcgcgggcggtgacgcaggtggtggggagggggagggggaaggggagatcgcgtgaggaaggggagcaccggaattttggaaatgctcgtggttttcagcgtgtgggaggcgtgagagcgtgagcgcgacgaggagactagggagagggatctagaatttctctgggggagaagtcaatgggaattgcgatgttggtgctggcttttgtgtcctctggtgcgcggagtcctgcagcggcacacataatacgaatactagcgctacgtggtactattacacttagtagaatggatgaaggttcttatggaaattaaccaacttgaatatcaatagcagtggtaaagatgtagtataacagtatatagcatacctgtagcagataatatttcatacaagcggatagtctttttaatagttctttaataaatatagaatattggacaacaattcatgtccgatcgatccatacatgtaataaatataaagttgagagatgatttctagagttttagaaacaaaatgtgagtactcttaacacttctcaggtaacacaatactcaacacatctggtgtaaaaactctccgtagtcatagttgaggacctccgacacactctttgtcttcctggcgagatagaacactgagtaggatatggcggcactcatgaccatgtgactcttgctcttgaagaacctctccgtgcgaacgaaactccgaccatccgctgggttgttgatatggtcaattaccttgaaagtcgccgcaacttcttgtaacccgggaaccagtcccaaagactccactagaacgctctttcccgaagtgttcaacgtcttcttctccccttcaagctttatacctcttctgatcatggatttgataacagagacgtcttgacgaattcttgagatgtttgatgccatcttattctccacatggcgaggacttgccatggtgcccctggtaagaaaaaccttatatgaagcaattaattaatattatatgtttaaacggtagttaaatggtgcccctaactatatgtttaaaaagaccttatatgttacataaagccatgaagtattcaagacaaaggagaatatgagactaaaaactttcacaggcaaagcttgaatcagaacacacaagtcatgaagactacaggaggaacaaaagtttattgtatagattgcaaaaaacaatggaatccttaagtttaaatagctgcatttgtattgacatttatgtaatgatttcaagctgactacacggtactttgtagctagcctaacaggtaatacaccctgtagataatacgattgcaaaacatcttttatttatacgatgtgcaattatattctctagcaaggaccctacagatcgagctgttccaaccagaaatgatttgttattctaatagagaagacgagaattagtctactgctacctctttaaaaaaagatcaatcacgtaaaattaatgttactatcattaaacaaactatcataatatgtatttctttttatttaaaatatattatttttatagatattgttggttaaaatagtatttcgaagattatatcgaagatcaaaaaatacttatattttgtaaggggagtattgcattacagatctactccctttgtcttaaaaaaactatttctatatttgaatctggatatgttcagatttaaatgtagaaatgttttttttcttttttttaacggtgggagtacttagcataggagaggtaaacaaacaaaactactgtagtacagtaatacacagagggcggcatcagtgttatttctggattaggcgattagcaccagctttgaagcaaaaaggcaaaaattttaccgcatcaaattaaagcacggtcacacagacctcaccatcagacctccacgacgaagccaaactgattgatatatagaagcttccataaagaaaagaggaaaaaaagcgaaccttctagaatccactagaaggcgatcgaattactacccagcacacaaattggcagtctccgcacgaatccccgcgcgcgcgcacgaaacacaacatgtatatgtaatgagaataaacaggagaaataaccagctaattaaggagaaacatatataaggttgcagcacatcgaatcgtaacgagatcacaccgcttggaacatgatcagaggctcacgaaagtcccaaccttttgaagcgactcccctccaggaaaagcatcccgatcacattccagaaccttctacccgctagctttcacgccatgcgctggtgtcgcaaaatcacagcttaagcccccccaaaaccccaagaacactcccccctacccccaccccaccccaccccaccccacccaaagaaagaaagaaagaaagaaagaaaaacagcaagcacgacatgcaagaagccgaactctggtgtggatccgagctgcggatgagtattttggggcaggtgagggagatcggaggacggaaaccctaacctttgcttcgaactcgaacaaaccaatacggggaagagacgcggcgccgaggcggagtggttggggagggaaggggagaaaacgaaagaaaggtgatgctgaggtgcgcttgctactgcgctgcggtgctcatatgcgagatgcctctgccacttatcgggttaacgggtcgtatatggtaatatccatcaccctcagagtatctgcttgatccccttaaaaagaattctcagttcatatcaatattacatcctttccccgttttaagtgaagttgtgtatttccgtctctaacatttgatcgtttgtcttatttaaaaaaattaaaaaagttagccgcacataaagtatttattattcatattttatcatgtgcaggctcatcctgctaacttggtgtgccgctggcaggacagcagatccacaacacttataattactagaaaataagcacgctcgttggcacgttattttcatagcccgtgtgtagtcttaatgttgaaattttaccgaaccatatcagagtcgatgtgactctaatgttataaaatttgattattaaaggtatagttggtcaaaattagcaccttaaagtaaaaaatgtttttttatcaagataaggagtattattaatggtatattatatttacatgtgttttatgatagtttaaaatatacatttctcaatacctattttttagaaaaaataattttagttcatttgtttgtgttctcaaataattatcacgaactcagtttcatttatcatccattagctatatatgtgttcatagttttctttttttcttcgcaacataaataaatctggtctcttctttgggatataatgcgtgcactaaattattacaatcgcaacatacagttattttcatgccctttctaaaaaaatattacccccatcctaaaataagtgcagccatggatatccgtacctaatgtttgaccatccgtcttatttgaaaattttaaaaatatttagtcatacataaagtactattcatgttttatcatctaatagcaatgaaaatactaataaaaaaattttcaaataagacgaacggtgaaacattgaccgtgaatagtgcaaaactgtacttattttgggacggagggagtatattttcatgcctccccccaacattgaaaaaaaactattatcgtatatataaattttattcgatgttcttcaacaattgtacatatataagttaaattttcaatgagcagctcacataagctagcttaatagctacgatacgttgtactcccttcgtttaaatatttggcgccgttgactttttaaaatatgtttaaccgttcatcttattaaaaacttttgtgaaatatataaaactatatgtatacataaaagtatatttaacaatgaatcaaatgataggaaaacaaattaataattacttaaatttttttaataatacgaacggtactctgttaatggacggtactcagttctgtccatcagaattaatcttttgagtaactctgtttcaaaaagatgacgcacaccgtgagcaaccacaaccaggcacttatccatcattaggactgtttttttcgaacgattctccccagaaacaacgcaaagtatagagcatgaaaaaaaattacaactctgggagatcgtaaacaggaaaagaagaaaaaatagcaccgcccacacaccgatagctctagcttacaaacccgggagaaggctagcatcgtaccgaccgctgctaagccaacaaaggaattcaagtgagatcgtctaaaatccaatcctaacaactgacaccaaactctactctagccacatcttcgagattgagggagagagtgagagagaagaatggaatggctctccacccaggccctctgacgtggccatcttgcataagctacggcgccgacacaagaggacataagtctaaagtgagcttgcaccggttgtttgtgaggttttgataaagggcctaccaagatgacgtctctagggagaggagcgaaagaagcaccgccgccgccgttcgtcaaggtctcaaagagaaacgagactgggttttcaccctacacccgctagaagagatgggacgacacgacaacaccctaaagaggagaagtgacacccgaaaagccgtcgttgccggcctaaccaaaacggtgctaggttttcacccgtcgcccaccgcctgcctatccatagcagatacacctttgctccatcatcgtctaaacctctgtcggcgtccctcgcatgccaccacatgggcaccctcatcgtgcgctccacgccgactgctccacgccggcctccagcatgtcgcgttgcgccagcttaccgccaccgccagctatgtgttctcatgttgtgtcggcctcacgccacctccacgcagcactcgccggccacgagcctccaccaagcgctgatggcgccatcactgccagccgccggcaccgcccttccactgacgtcggtgtcgtccatgcacagtagcctgctccaccacacccccattgccggccgccagcgtcaccgcgctggcctcccgccgtgtcgctccgctccgtccactagctcttgccgcaccacacgtcgtcgccgcccacgccggctgctccccgcccagatccgtagggtgttgggtctggctacgctgcctaggaggggggatccggtcggggcagtgccggatccactgccccataccggagaagccgccacctcccacccgacgcgctctgctccgcctcccacatcaaggaggagcttcgccggctcggtttcccttgccaccaccttctcagtcgggctcgcggtttctagcggcagcaaggcgtcgagataggtggagagggtggcggcgcgagcagctaggatttcatccccaagctacccgcatgagagtgacgaggggtttgttagattgatatttttaggacactgcgaaccttgaacaggcaccacatggcaattcttttacccactccctgagaacgcaaaaagctcacctagaaaacacagatacagtacagatgttcgctattaccaaagatcgttactaattttgacacgaggaatcttgggggataaaatctatataccctaactctcttctcaagcatataaacgatttcaagtatatcggctttgattcaccaataaattctcgctgctttatatataaaatgtatttggtacatcataagtttgacgtagatagataaaagagttgaggtaattggttcaaagtaacacaaagataaaattattggattcaaaatgagtccaaagcgaaacaccgataataaaagatagccaaaagtaaaactttataaattttaaattctgtaaaatacttattcatatcatggttgcgtattttcactcttgctgcaacgatctttgcttgcaagggaaaagagacagcaaatgcgcctctgcctcgattcgatcgtatgcctgtttgccaagaggacgtcaaggcggggtgttgacgggatggaacaacgaactagcattgccaacgtacgaagaaacaagtccagctgtcatttcaatggctgaaccaggtgctcgtaataaccaaatgctgataagctgatgtcctgatgggttagtaacaattagtctttttttttttgctcggtgttctaaaaaaacaatcattcacgattaggacaaattattaaaaaaatcgcacgagttatactacctatgtggccctgttaagaaatataaggcgcagtttgactatttagttttaagctttgatcaataatttgtataacaatatttaggttttgttggattattcatgttcgaaagtactttctactccctccgtttcacgatgtaagtcattctagtatatctagattcattaatatcaatataaatgtgaaaaatagatgtgaaaaatagagaatgacttacattgtgaaacggagaaattatataactaagaattcgtaactgtaagagaaatttgtttttggcagtcaaatacgccttatatttctgggcggaggtaaggagatcagtacttatttacgtgcacgcctaattaagcaaactgcttagcggttaagttggggcaatatgtgcccgttaggggagtgaacccgttggtgcaacacgtacgtgcattgccgttttggctgcatgcgttaggtcgtgggccctacgaccatgcatgcatggctagctctgtgcttcaaatttaaaaatgctctcgatgcatatatggctgtgtttaggtagcttcgaacttccaacttttccatcacattaaatatttaaacacatacataaaacattaaatgtggataaaaaaacaattatacagtttgtatgtaaattacgagacaaattttttgagcctaattataccatgatttgacaatgtagtgctacaataaacatttactaatgatgtattaattagacttaatagattcgtctcgcagtttaacagacggaatctgtaatttgttttattattagtctacatttaatactttaaatatgtgtccgtatatatgaaaaaagttttaccaaaacaactaaacacggtctatatatacgttttctatcggatgaacaatatatttttgttcatttgggtgtggatgcgtggccgggtacactggactaaatgataaatgctgggtatacccttaagggatgagaatgaatcgaaactttttgtaataatatataatcatattcagttccatagttcgtctttacattttcgacaaggttgatattaattaaacaatttaaactttaacaataccaataacttttaaagcatttagtttgaaaacattagaacaaacataatgtgtatagattattcttaaacatattttaataaaattaaatgttcaattatatattaatatgaaccatagccaaaaataagtttcgaagaccgtgttgttatccaaaacgttaattaagaaatggaaccatagagtatcatagagtatactgaagaatattgttttatgtagattttgttggaattaatgaatgggccttagcccactcgaagattaattctttggaaaatcacaaaagcccacctcatgggatggcatgcatgtggagtttagtaccaccttgcttatttaggagagggggacctccttaaaaggggttgatagcgtctcttgatgttgaggagaaagctcgggaaaaagatgccgcgtctaagggcgatggtgggcagtccagtgccaatgttgtgcacaagacccagaacaagagcaaggggaaatacaaagctcagcagaccaccaacttcaagaagaagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactgggaccaatgtacatgtttgtgctgacatctcattgttttcttcttatcaggtcgcacggggttccaccgtcctaatggggaatgggtcacatgcttctgttcatggtgttggcatggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagctttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctctcgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaactatcactttcttatttgcgcacatgggggtgcttggcgaaagtcaatgtaccaataacgaagaagcgtaaacttggacctaagactgtggactgtgtttttctgggatatgctcatcatagcattgcctatagatttttaatagttaaatctgaggtaccggacatgcatgttggtacaattatggagtctcgtgatgctaccttctttgagagctttttcccaatgaaggatacacatagtggttcgaaccaaccctctgaaataattctcagttcaatcacaccaccagaacaaactgaacatacacatgaacttgtctctgaggaggatgtcagtgaagctcctcgaaggagtaagagacaaaggatggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgatacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgttttggctacattgatagtaagccttttccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctacggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaactattaataaactagaggagagtaccaatatatataccctctccaagtgaagatgcatatactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtaacttggagtcctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatgggatggcatgcatatggagtttagtaccaccttgcttattctaggagagggggacctccttaaaagggaggatgccctcctagccacttgaagcatgtgtggtggagagaagaggggaaacacacgcgcgcgctcgctcgcctcgcctcgccgggcggcccggcccggcagggcagggcagggcaggcagcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaaaccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgtttgttcgcgacagctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacagattttgggttggttgaacgaataattagtcgataggtgtggcgcgtgtggagagaagctagggggtagggccacaccctaatctcccttttaaatcctattaaaatgcaatgaaattggaaacataaagcaaaatccattagttgaaatgtagagttggggaaattcatggtctggttactcttcagattcaccgtatatataattaccccctccatttctaaataaattgttttgacattcttattttttaaaaagagataatccaaaaaaatgccattgacaagcgtccaaatcccagaaatgacatcgacaagcgtgagtttcaagaaatgccatcgtacaaacgactttgtcccaaaaataccattgccgttagggttccatccattccgcgccgttaagttctataggatgaacagtgtatttaacggcgcaaaatggacggaaccctaacagtgatggcatttttgggacaaaatcgtttgtacgatggcatttcttagaactcatacttgtcgatggcatttctgggatttggacgcttgtcaatggtatttcttggattatctcttttaaaaaactagcttaaatgactgtgctttgctacatataaaaaggaaaaatatcctaatattttctaaattaaataaaccgtattttccacgaaatatgtcattgtccaaattaatttatatgtggctatccatttagatataattgttacgtaatattaggaagtttaaaaggtaacatggaaaaattaagagagaatcccttatataccactccaaattaaccggttcccttatatgccacttcaaattggcttctcccttctatgccaccggttcaagtttgttatcccttttatgacattgccgtcactccaccgctagttgacatttaacttcatagtaaaaagacgcatttgcccttaagagttggtatacaaccaataataaatatactaatgtagctactggatacaacatatgaaaaatgattttttttcatcgcatgcaattttagccatcaccatcacaaataaattttcaataaaagcatgaaacatgcagttttccaacaatatttttaatacaaagagcattttccactagttctgacaaaattttgttcactcaaaaaggattaaaaataaattagttatgatgttttgaagtttacacattttttacttgagagggtatattggtcatttacgaaaaagtaacgtttaactaacagtcaactaacactatagtgctgggagtagcataaaatggtggaaaaacttaaaccagtggcatacaagggagaagccaattttaagtggcatataagagaactggccaatttctagtggcatataagggattctcccaaaaattaaaacaggagtaaatatcttaatttcctggaagcgcacaacatccatcctgccgagaggcacacagccgagcacgggcgctccagcaacaagctggtggtctcttgcgggcaggaacccggcctccatcttcgtgtagcctcatcgacgtgcgtagccacacatcatatagtgttccacacatgccgagctgatcgctcgagtcggagccacgataaactagcgccgacctccggccacactatagccgccgggccaggtgcccaagttggctcgatgaccacgtgtgcgggccgggacttggcgccacggactccggtaccgtggtgttggacgtcggtgccaaacaactctagtgccgcgatagagtctaaatctaaaacatgtgttttagaggatttatttataaaaaatgtttctgaaaggacttaatgtgaaaaattaaggcctaaaaacctggctatatgaaaaaaacaacaaagtacggggctctcgcgtcgtcctcatgagggtggcttgggggcaacccttagcggcccacgccaccacttcctcaccccatctaaccgcctcgccgtcgctggaaaccgcacgggcggccagagtgttcggtgggacggatccggtcacgccggaggcagatcccctcaccccccctccccacgtggccatatcgggagtaggtgactccgacaagtggaggagcccatggctgcgcaacccggtagaggcgtggggcagtgcggtctggtggatgcacggggtggcgtgacggctgtactggctgatggtggaggaggccaaacgtcgttgccgggagaaggcagtggtaggcccgcgccgtgaggaggcgcggccggtggcagcgaaggccggcacagaaggggggcaaagccagcggaggcgaaggtagacgaggtgtggcggccggtagcggaggccggcactgcgcgatgagggtggtggcacgtggagactggccggcgaggggcgccggtgtagctgtgcccgcgagccgatggaggttagacggcggtggagcgatggtgcatcagctgtggataggcaggcggctggtgaaaacctagcccgaccaatggtggcgttgtcgtgccgtctcatcccctctagtggggttgccgggtaaaaacttagtctcgattctctttgagacctcgacggacagcggcgacggtgctttcgtcacttctctccttggagacatcatctaggcaaccccttgttaaatcgtcccaagcaactggtgtaggctcgctctagattctgatcctcttgtgttggcgtactagattagggaagttggccacatcggaaggcctagggggtgagcggttccattcttctctttcatcctctctctcttattcccaaagatgtggatagagtggggttttgtgtcggttgtaaaggttgggttttgggagatctcgattgtagttctgttaacaaccaaatttgataatctaagtatcggagataaagactagatcgaagcggaatccaagttcgatatcgtatcggaaacagagcaagaatcggctggactccaaatcggctacgaccagatcggctgagtccgagtcagaaagggaaagccgatacagccgattccgacaatatgattcggtttacgtcatcaagctgagttaatatacttcacgtggattgccacacacggatagagtcctaagaagggaattgtatctattaattaggatattttatgtaatttccttagagataagtacgggcaaaaatctgctgcaaagacttatggtatcttagagtttgttagagataagagtcgtgtctgacaaggacatattttgtaatctcgggtataaatagaccccgagccccatgtaatcaattaacacacgttaaaatacaatttcggcgcatcgccacccttttgttttcattttgtttcgacgagttcttgctttcgggttgagctgcatcggtttcgatcttcaactagaggtatgacttgttatggcggcttgtgttctcgggattagtgcttccatcattatgatactctaatcctgtccatgtaagttgtcgagttatcatatatcttatataatctctgacaatatcgctatctaacctctaatcggctaatatctatcactagggagcagccgattaggttaaatatcgacgttggcttagattatataagatatctaccactctatgaagcttccaatagcttgattgtctagatattgtcttttttttcatacttatggttgcatcagttgagtttgacctcataagtcgtgcttagaattataatctctagcctgcttcttggttgttgattagggtagtgtcggggtttcagctgatcttacctgatttagccttatgtttcatgtgcttaattgatatgcttgattcgccctttatattgagatcttattgcttttagatatgttaagcttcttgtttaatatattttactcgttttaatatcttaatatagagtagtatcggagtattagctgatacatgctagatctatcttatcggctatgctatgaacatatataatctcgttgttaatacatattgcgatctaagtgatttatactgtctcggcatggcgaccgatctatcccaatcacttgatttaagtatatatcgacataaagattatatactgttaataactacagccgatcgaatagatttagttcctttattattgcctcgcacagccgatcgatgcaaagatgacatcggctcgagtataaatgatacgtcatcggcgtccggccgatcggctatcatttatggattaactgttattcctgtttcttgttgattgtaggatcaaatcaactgtcacgccctcaaacctaaaggcaagatattttggacctgcactggagttaagcagatctcccaagcctcgtgtttttacatcaacaagttcctttatcatgaaacaaacgatacccacactttaatgtggaacatattgataagtactcatatatgttcaatattataaaaacgatggatagatttgttaaaaatattattttttttacttcaaagagggaattttattgatttcggaagagaggattacattcttggtctatcaagtctaagattcctgcgggagcacacaacttccactcctcacacgatctagacctcatagccatttgagctaaagcatgagcaatcctatttgcttccctcttgatcttgcaaacctgcacactttggagacactacatcatccctttcgcttccttgattgtcgctgcccagggtgatctcgacagctcctgttgtgacagagccttgaacgttgtcagtttccaagattattggcatatgaatccattccatggctacccttaatccttctagacatgccaatgcctcagcttggacagcagtagcacaggatttcagagttttttgcgcagcaagcagcactaaacccctgcagtctctaatgatgattccagcagttgaaactcctgtgtcttctataaaaccagcatccacatttacctttgctgaaccttcgggaggggcgcgccatttatcaacctgattggttgtccgaacctgcactaatttctcctttggttcatcatacattaatccttttcctttgatgtcatcgctttgttgtcggatcagcaacaataccttctcatagttgatgaggaaattaacagactctgcaattgtggccgtcccctttccatggatcatatcattcctgaggaaccatgctctccacagcaagtataaaacacgcgccttgtcagaactactcaagctatccaacaggacaaggagccagtcaggcccagtcatagcaaacttccttttcggcggtagcgcccagaactctctgatgacttctcgcagcgatcacgccatcgtacattcaacagtcgcatggaaaccatgttccccctttacaccacagatagggcagatacctacaggttgtatccttctttttcatttattctcccaagtgggcagcctgctgtgagcaagtttccatgcaaaaatcttaacttttggttgaacgtctgccttccacacattctcccagagcttcctttcaccattggtagcagtgcttgaagaggtctgaacttgagcactctcagttaaattccatgctagcttataggcgcttcttactgaaaaaaggcatgttttctcgtagtgccaagcaggaaagtcagatgtctcctggttcggcacatggatctttagaatagcatttgcatcttcctccgtcgcaacatgtctgattaaagcctcattccaggcgtttgttccagggatcaggagctcatgtacatacgtgagcctattccaattcttcttctgtataacctcaactttctcaccatgcgccacccatctattcctccaaatcttggtagtccgcccatctcttaccctccaaatcagtcctctctttagcaattccagcccatgttcgattcctttccaagttggtgaagtattggacgggaaagctgtatcaataagggagccattggggtagtactttgcttttagcaacctagcgcacaagctatttggctccgcgatcaacctccatgcttgacgtgctaataaagcctgattgaaacaccgaatatcccgaaagcccaggccaccatgaagcttagggctcgtgagcttctcctaggacagcagtataacgtcccgccttcccccaggccaggcccgagctttcataggtcatagactgccctcacagaccaacacatgtcttttctgcacactttgtcctcactcgtgcgcacccgggccaagcattcctgcacacaatttgccttcccccaggccgggcccgagctttcataggtcatagactgccctcacagaccaacacatgtcttttctacacactttgtcctcactcgtgcgcacccgggccaagcattcctgcacacaatttctcggtcggtcatccatcccaaattgctccatgccaagtacgcttaaccctggagttctttggagatcggtttccggaaaagaagttgcaacttgttgatatgagtattctattaatcctattaagccctgggatgtcacatcctcacccccttaagagagatcgacgcccctgtcgatcaaccccaggccaggaacgtctgtccagtgccagcgcatgtgccatgctttcataggtcatagactgccctcacagaccaacacatgtcttttctgcacactttgtcctcactcgtgcgcacccgggaagaatttctcggtcggtcacccatcccaaattgctccaggccaaacacgcttaaccctggagttctttggagatcggtttccagaaaagaagttgcaacttgttgatatgagtattctattaatcctattaagtcctgggatgtcacaagcagatagaaacctctcacaccaatctgttaatctcttagaaaatctttctttgattggttggaattgttctgatttcatcctaccttcgggagttggaaggcccaggtatttatcttcaaaacctgttctttgaatctgcagaacagctttgatctcctcctgcctctcctgtgagcaaaattcactaaacaacagagaacactttgctgggttaataagctgccctgtgcttttctcgtatagactgagcgcctccttcacacttctcgcttgatcaacctcggctttaaagaacaataagctatcgtcagcgaaaagtaagtgggagatccctggggctccccgacacaccttaattggttggattgaaccttccaagctcttcttctccagaatatgtgacaacccgtcagcaataaacagaaacaagtatggactaagaggatcaccttgccgtagacctcttattggacagatgtcaacacaggacattgtccacttcctccatgtatctccaaaacccattctttgcaacacaccatccagaaacgcccaatcaactctatcataggcctttgaaaggtctaatttcagcgcacaaaaattctggttctcccttttgcatttttgatggcatggaagcattcgaaagcgatgagcgcgttgtccgtgatcatgcgacctggtacaaaagcactctgtgcatatgatattacatcatgaaggagcggtctgagccgattaacaaggcatttagctatcaacttgtatatcacattacatagactgatgggccagaaatccttcatctcctccggcgacttagtttttggaatcataactatgacagtgtcatttgctccctcctgcatttcgccgttttcaaaaaacgcttgtaccactctaataacatcactctaataatatttgttaaaatattatgaaaatgatgtagggatgattattggatatgcttgtatgttgatctgtagaatttgatagattgtagaagatgttgtatgcttgcatgagattgaatatgtaattattgtttgatgatgtggcgtggttgcatgtttaactttagagctagtgagttataactttatagaaaatatagattagtatcaattcatcgtcttactttactcgtaaataactttcatataattagactatgggtgtttggttaccgagctatggctgcaccgtgaccagccgaaactgtccagcaagctccaagatagcaggctgcaggcttgtagtcccagcttaccaacatgtccatgataaataaattgtactgtaatttttatgtagtggtgcaccacatttcgataatttgacacaatatttttagtatttgcatttttttctaaagaaaatagtaaatgtgtaccatgtcaattattatgactatgagaaaggtaaaacaattgaaagaaaggaactagaagctcctttaaacagttcattttacagagttttttataactacaatcttaaatcagaagctcatccaaacaatttagttttttttccatattttaagaagatatatttgtagaattaaaaaaaaactagaagccaaaaactatgtttatctagatttctatatttttagaagctaatcagccgcttgtcataatactcccttcgtctttaaatataagtattttggttggatatgaaatatcctgtccacggacggagggagtaaatcttaagggcccatttgaattggaggaaaaacatatgaattttggaggatttcaatcctatggaaaatttttctatgaagccctttgaaacaaggattggatcctatccaatcctttgaaattccagtggaatgaacaatcctatagagattttggaggaaatttagcaagagcttcaacctcttggtaactttcctttgagtatatctctctcatctaattcctgcgtttttcctgtggttcaatcaaacagtcattcctgtgtttttcctgtgttttgtaatcttttattttacacttacattcctactaaaattctacgttttctcagtcctacgattcaatggggcctaagctcagctagagaggccgtttagtcttgtgcacgggtgaggaagtgagtggcgtgtggtgagtggtcgggtgcgaccgttgcgacgggtggtggttcggttcggtgttgtggacgagaagtctcgaatcggcttggctcaacctaaccccataccacccggcggatcaagctccaaaaccctagaactcaacggagcgagcgcgtgggtcgggatgtcggcggcggtgagtgccctccgccgcgccctgtcgtcgtcgtcgtccgcggccaagaccagcagcagcctgcgccgcctcctccccgccgcgccacttcgccgcggggtcctctcgtcgcagccccggccgtcgcgccgcaaggacagcatcgaggtgcattctcccctccctctcttcccttcccttcccatctctagtccgattcccctttccagcgagcgagggacggacgatcgatcgattgattgctgctttttgtgtaaaattgtgtgcgtccagctctctcggagtgaggaggggaggaggctcgccggccgtttcgacgagattgaggatgccgtgcacgccattcttatcagggacatcgaatcctaccgggccagcaccatggccgaccaaggcttcgtcgagagaaggctcacctctctggggttcaccaagggatataccagggaccaagctctttggctttccaagctcgtgcttgcattcttttcttcgtgggtcgtagggactggattcgccaaaatcgacgacagcctccatcaggtcacccatccttgtttgctcatttgcaatttcgcataagctcaactttttgttgtttgcactgcaatttgccaattagtcatttaccatccaccctgctgcagaatctgtgattatcactggagtggagcgttacacatgcatgaattttgtcacccaacctcacagcgatcatactgaagattgtgccgcgaaaaataaatgtgaacgttttatgattctcttctctcaagaacattgggtcgtatcatctgataatttcctcacacagtatgctatcagagtgaaacaaatacatgagaattgtgcatctgtatggttttgagcttaaactttattagaaaggctgtaaacccatgagatgatctatgatcattccttgattttgtggttcatctcttgttttggttgcgcagataatcaattgagctgtttcggttttctctacgtctaaattcactatatctaggaaatctatggatgcttatctagtttagcacttgtctctcttttgatggtgacagtaacattctcttaacttgcttagtagaagtattatgaattaaagggatttaaactacttggctcgggtaacccaagtatatacattcaattattcatgagaaccttttccatgctatacatgaacaagtatatgttgtatgccaacaatttgaaaatggttgatgattgaactctgaaacctgctactttgtgatcaggactgtggtaacacattcccaaataatgtttctccagagtcatgctagattactatcagtcctcaattatactagcatgcagcccacaaattattaatcttgtgtaccgagtcatgcttggttgttaggtaatgattgatgcattcttcatctatatatctatccttccgccatgatttcgtagtaaagctttacttcttttttcgtttcgttttgttttcttttttgaaaaaaaaggcaaaattattgccttatatattgataaaggggtaagaaaacagcatttacaaggggggtgggagtttcggtcatccctgaccagaaacgaggcctactctcccaacggaaggaactcagctaaggactttgctcctaccattatccagagccgtgcttcatccttagttttagccaggatgtccgtttagtgcttgcaagttgcctgaaaactctcgagtttctttctttccacaacttccaagagactaggatgattagtgattttaagtaaagctttactttcaaatgcatagcacaaacaatataatgttgattttgttagtacttacactgtgaaatgttcgattgagctgatattgtgggctttataagttatagcttctagctctgcatctatgctttgcagttgtggaaattaatgaaatttgtgttcttcgaatcaaagtcttacttctatagatcattcgattacccagagctgttttagtctgtaatgcttgtgctcctgccaattttttttttcatgagcaaatttgtgtctattattggcaggtcaattcatgaactgcgccttcctgttggttgacggatggataaataatcaaggatttttttttgtagtgtgtttacgttttaatgtatggtgtgactttaccgtgcggcctactttgtgaagggattatgatttcgagcttgtttttatctcagctgttgttgtggaagagcacatttcgcaaccaatggttcgtatctgtaaaaatttttaaaaaatctttttagaataaagtagcacgtcttcggcagcaagaagaacctctgctgtttcttacgaacctcctcacaccaagttgaactccaaatcagttgctgcatcagcatgaatgaacaacaagtgtttgatgatacaaaccggaagaaatggaatcacagaatgagaaacaatactctgcaggatgagaagaaacaacactctgatgggttcaagttgtggttgataacacgtagaaaaatgaatgaacagaatagtaaaaatatttttatgcgtgaaacttttctatgtctgtattattagtggtttaataaaaaaaaggcaaggctagaaaacaacatatactaggatgaaaacccctaaaatcaattcaattctaaatttacaaaattttaaatttgatttacggttgacaataataataaggggttgttcagttccccaaaaactttttctaaaaacatcacatcgaatctttagacacatgtatagagtattaaatatagataaaaaaaaactaattgtacagtttgcatgtaaatcgcgagacgaatcttttgagcctaactaatccatgattagccataaatgctacagtaacccacatgtgctaatgatggattaattaggctcaaaagattcgtctcgctgtttagttatgaaattagttttttcattcgtgtccgaaaaccccttcgacatctggtcaagcatccattaaaaaattttcattttacaagctaaacaggccctaagtaaagccaataaacagacgagagagagagacgacgaaaggcccacactgtagcaaactgtaagcatgacaagtgggcccggccgagacggaatgagaaaatcctagggttcgttccctcttcccaatccggcggcagccagcgagcgagaggagaggggggaaaccatgcccgcgttctccagggctcgaggcgccgtcctccgcgtcctcgatggcttgaagcgccgtcctccggcgagcggggcggcggatactatggtcccgtctagctacatttccctccggttcctctttttattttcttcttcttcttgtcttttctttgaaccttttcgtgttgccgattcctgtttcccaatgcagagcccagtcaggaagatccagatgcttgaagaggagcttcgtccgtccgggggagaaatctcacgaattctccaacgcgcgcgcgcccacttggaaagacaagaggagaaatttgatcctagctcacagtgagtactgtactattctatctagttccgtagtatatgaagtctcgttgctcattttatttacctttgattcttcatttatatgccgctatgtcatgcggttaagaaacttgctggttaattttgctcaaacaatttcactaaacacacactgcttgttagtcgcttggggatctcaccatctttccatgtgtgtatatatgcagcacataagttcatactcatcgcatcatccatatcttatagccatgagttatcttacgcaacgatcgcagttggtggccaacagccattattattattttttcttgtggtttctgtacaccaccagcttctgctataatatcgacacggattctcattaaaaacagcgttaaagcagtcactttatgattattgtgcttttaggttgcttcatcgctcggttagttcaactggttgatgctttgcaaataccgtgtctcgtctgtttttacaaaacatataattgctaataatccgcatatagacttgggtaatgcattttgtactaagtataaaagttagagctctcttgataaatgccttctttttccttcacgtggaatagcttgggagaatgaatgcttatatagttatattgaattgtctcttttcacatagtgaattgtccagcactctgattggttacaagttgagagatgaataaagcatgcgtcatattcaaaaccagctgtctgtggtgatagttctgaaggcatgtagctatgtggttgttgcatagaatatttaatttaaacgagtcaagcatagtatggttatttcacaaaaatgtatgaagctgttgatatttgtattcactgaatgtatgagatattttatgttgccataacataagaaagaagacgatgtcagaatatcagtgatccattagaatctctacatattcatagtggtataatttccaatcaaccaacagttaaaacaataagaaatgcctatgaagctgacatactgatgctattgtagatagactagtaggacaagatttctaatgttataattcccatattctaacatgtgtaagtgtaagaaatgccaatgaaggtggtaggctgatgctactataggttttggggctgtacaaacaaataattatcacttttgaacaattgaaaacctcaaacaacttgacacatcaactattacacataattttagtcttcttgtgcgcgggaattgtgggatgctaatatgctatgatccatcaccatgtccgtcttgggcaccactctgacccgaaggcccaaatgaaggttgtgttattttgccccttcatctggagattaactcctataacaacaaatatttgtgcacacaagttttaaccttttgttagaaggatcatactaagtttctatcagtaagtttgtcatgtttgacatggcttccataatgctgtttgacattgactttaattaaatttcacctttcattcccacattcgatgaacatcgtggtctcagttatttcagcccatggcgtcactaagtttctgatatagtacttctctaggagcatttgtttgctgaggactgacacattccactagtgatgtgtcatcattataactgttttactattctctacatgcatatatatttctgtacaaagagtccgagacaatgatatatatattttgcaggacgccggagttgttccgtaatggtgcaggttggcaattaaacaccttctttctatgccttttctcatcaatcattgccaactacaagtacaataaggtatgcagtgagatcattacattattctgaatacatgcattatgcataagcacatttaggattctatgaagctagcatgttatttatacaaaccaaccagagtaacaaacttgagaatttggaagaaaacaagcctcaatattgctctgaacgtaggcgcaggcacacagctgttctggcatccctcgtcatatgcaaatacaagctgcaagatatgctttgtcatttggaatagactgaacactaacaaaactactttaactaacagcagaagaagatgtagagctgctttttattgcctctaaatgtctaagttgcgacaaactactccatgaatactggaatttatatatgatctattctgaaatctgaacacaattgaaatgtacaatttttctgaacctaggttcaatactgtttgcattagcatcaagtagtggaattagaagagttttttaatttggaaattaaatgcgtgaacaataaccaatactatatttcctgcaataaggcgttgtcctgtaccttgtgaaagaaatattcatcgatgctcgctgcctcgagtaaagcatttagtgttcaaatgggtggtactcatatgatgaactcgttcaattgacagtgcacaaaacttgagacaccacaatcaatcctatggtaaagaaaaggggtatagatgaatctgcatccagaaaagttgtatctgttcagaaatgctttttcataaaattgtcactgaaaaatggcaaatgaagattatgatattcgttcatcagcttcctttttaaatgtaaaaatggcccactaaaacaaaattcatggtttgttgatcttgagttaaaagtatcttttgaatttgcagttgaataccggtccattattttcactccagacatttcattaagtaatttataggagggaggggcattttggaagctggataacgatggccctagtactttttgaatttgaaacatgttgacttgattaattttatgaaactagaatctttaggagtaaagtcagaatgatggcataacctcttagcctccaaacaagagttgtgaatctcaaaggactggaaggggagggcctttcgattttgcggtagatgaagaagagtgggtgcaaaaaactagaaagctattagcacatgattaattaagtattaattattacaaatttgaaaaatagatttatttcatattttaaagcacattctatatagaaagttttcacacgagacaaaccgtttagttgtttgaaaaacgtgttaacggaaatcatggtaaaatctatatcttaatcaaaaaagaacaggacctaagtagtgatcatacatcacagatggatgctttggaattagtgcaaatatgtgtggtagaagcataaagcaccaccaatacaaaatttgtaaatggtattttgaggtccaagtttggtcaaaacaatccaaatctactaacaattggtagtgcataaacgctagtctattaactccacttgcaggcttcctagcataagtaatttttttgttgtcttcatttcctttacattgtacactaaattgttttggtgcccgcaccgcaaccagttttcagaagtttcttatgatgctctgacacgaattgttgatcaatcttggcaggttgattgagctgtccttgcgttgtggaggatgtagccgagacggaccactggtatttgcccctcagtaaaatttgcctcagtaaatgactagtgtatggttgttttcatgatttgggattgaaattactcctggccggttgtttaaattgcaccatgacgtgtgctctgtgacttaagtagctgagtaccaatggaattgtctagttaccatgttgtggaattgtctcgttataaattgttatgcaactggcgattcacaaaccccacgacgagtctccagtagcgatctgttgctgaaccaaacatgaattcatgcgtctaggaaagagacggaacaacgcgagacgatagttatgaaacatgttacacgctgaacttacacaggaaatcatcactacaagaattttaaaaggcatcagatggttatgaacataatcatatataccacacgaaagtagccgcatgttcaacacgcatcttaattagaactcagaagtgccaactcaaaacaaacaatcagcatcatcatgttttgcttgtcaaaatgtcgcccttcccaagaaagataaagagcataaattgcttgtcagcataacaccacagtccacagtcacatgcttttaacttagttataagcctcttagaattaattattaactactagcatttggttcatgcttctccggttctcccgacctaaacagcaccccaaaaatcaccacggctgcaatctgcttgcaccacagcttagcccaactctgctgttcaccctcccggcgcagactgtacttacatgagaaataagtttagatttagtacacactgctcaaggacaaatcatgtgtgtaataaaaagaaacagcgtacttacatctttaggcattcagacagcacgagccctttctcaacattggcatgcgtgatcttacctctcgctgaaaatatgcctgcctgcacaattcagataccaaagttaaaataaccagtcgagttggagaaactatttgccggactcaactcaaattgattattatggtgcgcatgtaatgagggcagtacttgtcagcaggcatgcagcagcattactgatagtcaaacaatgagaagttagatgcaagaagtttctgataacaaaagaaacattatgtggatcaacggaatgcctagatgacgacaaaaaccatataaatctcagcatattaggaactccctggctgtagtcagcattataagctaaaaaacgcaaagtcttgaatctgcagactatgattgtaataatgtagtgcacccagtaaagagatgaacatgcatggtgtgacatcgtaagatcataatattgtaaattgaatttccagatcaattcagaccaagtccgctcaaagtaaggtacgcttggattggatcacacggtaagtacatctccaaaagcaattcaacaaattcaaaatatacacaaccattaaatgatgaagaatgtgcatcctttttcttcattaacctacatccactctaccaaagattggtccaagcttgcaagagtaccatccatttgaacagcataacaaaaatcaattttatataagaacctaatatcacttgtaatgagaaaaattagccagctatcacttgaagtcttggagatgctgttttttagagagaaaaaaacatgctcaacacgctacaatccgtaaaacgccagtgcatgtttcctatgttactaacttctcctatcttcatcaaattaaaggtgaaggcttccaaatgacacaagttttgtatctctcaccacttctcaaagatgggctaagttatttggtgagaggaaggtgtagtattctttcaatttcaaattcttgttagggggaaggtagtactgcactactgcatcatctaatcgaacaatttcttggagtaccaaactaaaataagtaatggagcaaacccaccgtagtattgtactaagtttagcagtagcaacttcaaatcagcactcagcacatttgagtttaagaccttatcacaatgtggatttagtgcgctacttctatcttctcctctacgcaagaaatgtattaaaactttagttgaaatttcaattagttggtatcattacctacgtactggtgaaacatctccaaattagagctcgcgttattgcagatgagttggaatggaggctagtcctctcaaaaaagaaaaaaaaaatgttaccagttcgccaaaaccaaatactatatcaggtcataaaacccttacagaagttccacccagaattaatccctctagaaagcacttttcgagattcgaaaacagacatgttctggcattgaaaaagatctggagaacaacagagtaaaaactggccatggagtgtgagaatggtggaaagtaatacttctactttcgactaatgttcccctcccgtcaccttccccaaaatgtttaatggaaatggacaagagagctggtgcacagtataggtaaatttggaaccatcttgggctttccctcggaagaagaaaacagtttggggatttgggggtactaaccttgttgaatgcagatttctggagcagaagcttgtcaatctcagtgtttgtaagatcaggtcgaatgccacctcccattgctggagagaaggcacggtgagcacctgctgcagatgccacagctgaggtggcgtggtgggtgatcgaagatcgtcgaaataaggaagccatatgcccccctctttcagagctagcagttcaattaattcagttaaaacagttgagtatttttgtttccttaaaaatcagtaccgaattaactagaatgaattctcaatacagaacctaataaacccagctacatcagcagatcagcttgctctttttttttttttggtatctaagtgtatcattactacatgcaagtgtcatgtgaccgttgtgacgtgagttataccacaagtaaagaagagaaaaacctggaatttcaccaagcaaaccagagctaaaaattttaaaaaaaacagaacgtacacaaattcagaagtaaatctatctatccatttattcccaacaacaagaagaaggaattaatcttctggacatgataagaatggttgccgtgccacaatcacaagcgatcacacaaacacgaagagtttttagtcccaaatcagaaactactccagttcttttagccgcggacggggagaagatcagagagaaaaaaaaaatccaaattacttccaactcgaaggctcttgatccgccagcaaagctggtgggcgaaaggaaattaagagacaggtggatgctggtacctggggcagaggcggcggaggcggcggcgatgggcgagagaacagtcggatcgccgggacagaaaaccctagaatatataggaggaaggaggtcggccggaatggatcccctcaagttggggtagaactctaccggtggagttgtccaaatctatgtcatctgttacttgtttccaacggctgagataatgcctcatcagtttcatctgataaattaactccttaaattaatatgatttttaaatcaatttttttatagattttttttaaaaaaagacgtactgtttagcgcaattcggaaaacttgcgcgaggaaaataagagagtatgagttgggaaagacaacttccgaacgcactataagagcgactacaataaaattatgtaagcagattgtacaagttgccatatcatatttgtatttatgtggaggggagaggagaagaaagagaaaaaaaacgggctatagatttgtaaccaactattattaaacttgctcaaagattatgttctttcatcccttccaaacttcaactccctcgttcacacgttttccaaattactagaagatttatttgttttaaaaaaaaaaatcatacatgaaagctattttaaaaagttctattaaatccgcggcttcatttcaccaactacactagcaaacacaccctaacaaatgtccaaaatggagtctaatccctaaattgtgttttggaaagaaaaaaaaaaggtactccatttagttctcctaactggcgttccgcaaattggaattccctttcacgttctttactccttttagttctccactaatctcccaattacacgcgtgagatgcagagaatataggaaaggtgtgggaagggatcgtgccatggaggaggagacggactgacggagaacgatttctttttggggcacaaacaaacccttcgatgctcacagatgctcacatcgtccgactgtttgcatattaattagacgcaaccaagcaaactacatacttcgttttaaagtataacaacgcctttaaattttattcctacttaaaacaaaaattgccctaaaatatactatataacaacatttttcacctatattttttctcaactaaatacaagtatacaacattttaccattcaaattccttacccttctcaaccaatcacgatattattctatttaattctactatttttttaattccaatgtctaacctaaaactctttatattttggaattagtatatttggttgggggttgtttttcttcatttcttgggtggccacggttcacgatttcgtttcacggtcccaatgagacgagtaattttgcttccaacaaaatttaacaagaaaaggagcgatttgaagaagctccaaattgacattttgggtgacgaaattcaaagaaattgtgaaccctggggtagccaggattcggagcggctaaaccagtgtttcttcccaattcaaaagacaaagagaagactcagcgttcctttttccttctaccagcaaagctgctgtgtactctctccgtactcgtaaaggaagtcgttttggacagcgacacggtctccaaaacacaactttgacttattatttgtacaaaaatatttattgaaaagtcatatgtatacttttatgaaagtatttttcaagacaaatctattcatatatttttttacattttcaaactcaacaacttaagagttattcatgatttatattcccaaggtttgacttaaacattatcctaaacgactttctttataagtacggagggagtatgaaactaaatgtctccactgcgacatgttgaaatgcgtaggccaaaagtataacaagtagttaataaaaatgtacaactctaatgctgcctccagatcacaatgtaacagatatcagcatagttgaatggaaacaaacagtgcagttaacatatccaaagggagatctagattagatagagacttccacatttgcacacatgggacaccttacatatgtcctctacaggcgggcttcttaattcactaaagattgcctttttttcctggttttctcctcttccatacaatagccagtgaagtagccaccaagaagaacggcggtaatggcccatgatcgaccgatgtttttgaagtgaacctctctccgaacaatttcaaagctacaaacaaacatggaaatcgtttgagctgtgattcaaacaggtatgaaatggaaacaggggaatatgcacgcactttgaaatggttttgcccaccattaccaatggcacggaattgagcttcttccccttaatttcatccagcagtgcatttagctgaaaaaaaaaagaatagcatccatcaaataaagcatgttccatctggtttatcgtactagatatggaactaaaacgcagtatgaaacatgtaccatccaacaaacacctataaccacctagttgcatgcgcaggccgaaaaaatgaccacagatcttgacacggaaatgtccactcaagaactattttcatattttcataagcgccaataaacagaatgaatatgtgtttaccatgaactttccaatggaggcatgagcaaatgaataagttaatatcaacaatttaatcataccaaatcagaccacacttgactataacaaaagatatatattttttgacggttcaccgaggggcgaaatggccacctgaatatattaagtcaaatggtcttacacagggcaaggctttcgctgtgcaaaatatcccgtgatttttttcaggtgctaaagaagacctaacaacaaactagtataagagagcatacagctacacctaatgcgcgtagagaatactaacaaatacaatcaaggatcttattcagtcatggttgtttgatcaagtctgatataacagaataatgaaggatatgaagatggaaaaggtctggtcattgatatgctcaaatgcacaatctgtgcaactgagaagaaatattgttcacatgctctttattaatgctgaaacgtgagaggcttgggatcttcttacacgagtttataaatgcctatcagacttaagtagttgcatcaaacaaagagaatgaagtgatcacaccaccgagggcaacagccagatgcaatacaatcatcaaaggaactacaaagccaaacataatatgtactccccccggacacaaaaacatgtcgcaattgcatgtgtacacgcaaaccatattaattttgatcaaatatattgtttacaacatgtaatttggacatatgaaaatggtactggtaaatttggtacagatcgaatcaatactttcataaatcacatatctataactcttgcattatggaaataaaatttagtggacaaaatgacatttgattactttgaaaagtaacaaataatagttgtttttctttaactgaaggtagcatatgatagtgctgaaggatattcagagagctctatagagaatgcacatgtagatgtgtactccagtattttgtaacaaaatttatcagtactccatgtagatgtacatagtgctccatgtagatgtagctagtgctgaaggagtataaactaacaaattggcatggaaacactagtattttctaaagtgggtttgtatcctccaaactttataatatattgtggcgcagaactttcatctatggataaattgactctgaatgtgtcttatcaaaagaaaacgaaaaaagaaaatattttaaagaacacatgctagttccaaatggaatgcatatgatagcaactgcaatgtaacgaaacataggcaaatgatgtttgttcggaataaaaagcaccagaaggtttagccgtttagctaattcaaaccataaggaattgtttcctttggttttgataacattaaggtgtttgtgatgtatcataccatgcatttcaaatatcagttcaaaaaatacgcagtggaagttaagcatactacagtatcatgaatagcactgttcaaacaagaggccctaagaacgggttaagaaaatgatgaattctggaagaaaggtactttcacagcataagcgattcaatcataaacaatgaacttgatgtctgaaatcggaaaaataatcaagcaaccacacctctttacatatcaaggaacagaatagcacaaaaataatgacaggaaaggaactagggctagggaagacacaaacttgcaactttacagggcctactcaagcctgccaaaaacaacaattccagcaccatgactaattcttactggaccaagaatgctgatgaggacaagacaaggccttgagctgaacaaaagacttggcacagatttggatgcttatggtgagagggaacgcatgtagaggaatgaagcagtaacggataattcaagattgactagattacgtgggtcgaaccagagcattgcgggatctaaagcgaacaatggatgatgcctcccatcaagtaaaaagacattatctaaaaatcaagtaacaagtagaacccccacccccttccacaaaaaagaaaagaaaagaaacatttgcccccaaaatttgcagtatcaagaacattcaaggcaacaccttttatctatctattcagggttcagggtgcaggtcgttctgcaactcgcgtatacaatatttggtttcgaagagggaaagaagaagaagaagaagaagaagaagaagaagaagaagaagaagaagaagaagaagaagaagaagaagaagaagaagaagaagaagaacaagctttcctctgctgtaacgaacttgggggccgggattaccttggtggccgcctcagataggggaggatacggatccttgtggacgcatccgctccctgcctcgtgaacgccaggagctggcttgcgctggctgagatcgccgccgcggacctcggaagaaagggcgcggggacggcgagcgcccgcgcgtcctgccttgccgccgcagcccaagaaagatcgcgcaaacgaagccatgcccactcctctctttcgctgccagcgatcgcggctgcagggttaggttgggggttctggagtggagtgcgagaggtatggggaattttggacttacgccgttttagttggtggcaaaatcaatattaaagattaaagttgggtaagaccgaaattgactctttccttttcgggggaattggtttcacagtccattccctcagttattaaaaaactcaacctaactaaaaatataacttatcctaataaaataaatttaggcagagatactactttagagctattactaaaaccatattttattattaaatattcacttcaaatcactcttagcttatgataacaatccgacccaggtggggttgcccgaggcccgataacttaaggttgtccggaccccaacagtttcttggcacacccactaggggaaaggcccaatctccctaaaagactagtccaatagaggaaggttggctctcccttttaagatggcttcctcccaagctaagcaatagcttatgataacaatccggcccaggtggggttggccgaggcccaataacttaaggttgtctggaccccaacagttctttggcatacccactcggggaaaggcccaatctccctaaaagactaatccaatagggaaagggtggcttccttccaagctaagtgaggtgggattattcataggctcacacgttggccgaggcccaataacttaaagttgcccgggattattcagaggctcacacgttggccgaggcccaataacttaaagttgcccggaccccaacagttctttggcacacccactcggggaaaggcccgccgtctttgccagcaggtaatagtggaggagatgtcctcatcattcccacccccttaaacaagggcctagctctgataccaaatgataacaatccggcccaggtggggttggccaaggcccaagaacttaaggttgcccggaccccaacagttctttggcacacccactcgggaaaaggcccaatctccctaaaagactagtccaataggggaagtgtggctctcctttttaaggtggcttcctactcccaagctaagcaaggtgggattattcagaggctcacacggtcgtcgcccgactttgacgtctttaccagcgggtaatagtggaggatgtcctcatcagcttatctttgattttaaactagtttattttatctttgtttcaactttgaaccaccaaaaacttttttttatcgcatcaatgactacatgttgggcaaccagccataggtcataccccactagatgatggggcgcgcctttgcgcaccgcctagaggtatgctgcattgctgaccctgtggcaacaatgggtgaatgaaaatcattgcgttgcgctggatttaatccatatgcaatgtgtcgacgtttgatgtcgcgattctggtatttgcatagtatggggatcgttggtaccagggtatatgcgagattatagtaaagaagatggggacgaggatttttatacaggttcgggcccctgaattgttaggtaataaccctactcctgttggccgaagccggtcgttgctcttattcaccataatcacactaatacaatatatggggtagcctatctaattgttgtcgatttggcggtctgaagtgctgactcggagtcgacaacagggtagcctccctcctcaaatccgttctcggtgagatcagagatagcgctagacccctcccgacggcatccataggtaccgatgaggatcaactaggcttctctccgaagtcgatatccggcagcttgtcttggcgtatgttggcttgtatgttgatcttgtgtcttgatctattgttccgtttctcccctctcctcctagggggtcttgtatttatacccataggtgtccccttgtccaaatagaactaggaaaaccaatatggatataatccgagtagtccttgtcgtttccatgtagaactctattcatccttccttatgcggaactcgctccatatccgaggtcagtttccgtataagacatggtatgtggtgggtcctgccgagatttagtcaactactattaggtatgtggtatccataaccttaacacaatgcccagtgtattttaatccatatgcattgctggatttaatccatggatttgcatagttagaaatatctagctccataaaaaattgaattcggagttgtgccaaacagacatgggtctttttatacatttatattcaagcttaattagttctaaaattgctagatgttcttatattttaggggggaaaaagtagcatataacaaaaaatggttctttgggatgcaaagttggatcaatcttttaaatggtttttcattcattttcctatttattgtttctcctaaaaatataggatattaatgttatcacataattatctcaagtttcgaatttatatttagacttaacgtgtagtatatctgttgatgcgaaaaacacgaggcctgggagatctgcttaactccagtgcaggtccaaaatcttgccttttaggttcgtgagcgtgccagttgatttgatcctgcaatcaacaagaaataaagataaagaaaccgcagttaaatccataaatgatagccgatcggccagccgccgatgacatatcatttatcttcgagccgatgtcatatatgaatcgatcggcagttgtgaataagcaaatcataactaaatctactcgatcggctgtagatgttagcaatatataatctttatgtcgatatatacttaaaccaagtgattgggatagatcggtcgtcatgccgagacagtataaatcacttagatcgaaatatatattaacaatgagattatagatgttcacaacatagccgatcagatagatctagcgtgtatcggctaatactccgataccactctatattaagatattaaagcaagtaaaatatatcaaacatagagcttaatacacctaaatgcaataggatcttaacacaaagagcagatttagcataacaattgagcacataagacataaagctaaatcaggtaagatcggctgaaaccccgatgctactctactcaacaaccaagaagcaagctagagattataattctaggcacgacttatgagatcaaactcaactgatgcagccataagtatgaaaagaaagacaatatctatacaatcaagctattgaaagttttatagagtggtggatatcctatataatctaagccaacatcgatatttaacctaatcagctgctccctagcgatagatattagccgatcagagattaaatagcgatattgtcagagattatataagatatatgataattcgacaacttacatgaacaagattagagtatcataaagatagaagcactaatcccgagaacacaagccgccataacaagctttacctctagttgaagatcaaaactgatgcagctcaacccaaaagtaagaactcatcgaaacaaaacgaaagtaaaagagtggcgatgcgccgaaattgttgttgaacgtgtgttgtcgtattacatggggctcggggtctatttatacccgagattacaaaatatgtccttgtcggacacgactcttatctctaacaaactctaagatatcataagtttttgcggcagacttttacccaaacttatctctaaggaatttacataaaatatcctaattaatatatacaattgcctttttaggactcaatccgtgtatggcaatccatatgaagcactttaactcaacccgatgacgtacaccgagtcgtattgccggaatcggctcaatcggctaaccctgtccgactcgaactctgccgatcctgatcgtagccgatttggactccagccgattcttgctttgtttctgaaacgatcttgatcttggattccgcttcgatctaatcttcatctccgatactcagattaccaaattttgttgttaacaatatcttatttatccaatttaaaaatgcttcatttataatttttttaatggatgacgttgttgacttttgcatatgatatttggacattgtcttattaagaaaactatccaagtatcatatatatatatattacttgtatttttcatatttttattatgacgatgataaaatattaaataacgccatctattaaaaatgtggaaggagtagtaatttttacttctttctttatttctttattattttctttattttttccactttcattctatttatgatcattctatttaaacattctatttaacgtcatcttctttttttggccggcggggttttcactccgatggtcataaccgcagtgaacaagaaaggtcaacgtcggcgaaaatgctttttaaaggcgatcgaacacgtgatgactatgtgaggttgtgacttgtgacgtggttttgtgccgttgtgtgcatcaggcgtagcggtcgagatcgacgaagcgaaggagtcgtcgttgctgcgctgttgtggttgttcgtttctggtaccagtagcgaagaatgaaggaagaagcagcagcaaccgttggatgacgatggatagataggattcgagctaatgccaccctctgcattagcttctccaatgcagaggatctggatccaatgagtaccctgctgaagcttcttcagtttcttattgttttgagggtgaatacaatgtttccatgtactccataagtaagataaagaccatctagctgaaactgattgcagcaaaaacaatacaacgagaaatttaggaacctgcatgcactttatgaaactgcttcatccatttgtccagttggaactccagtgcagctttttcactggccatgcccatgcatggattgtagttgtgtttgctgggagaatatggacccatacagatatcacttaggctgtgttcaaccctaacttccaactttccatcacatcacatcacatccaaaactttcctacacacataaacttccaattttttttccaaacttccaactttccccaaacttccaacttttttcaggaactaaacacagccttagtcttattaatctaaatatcaaggccgacaaaaaggaaaagaattatttgattccaagcataccagaaagtcagtagtaataactaataagctgcattagtacggaggttatgtcagtcaagacgtttggataaagaaatttaacccgtgagcatgatctggtaataagctgcaatactgcagtagtaatgtcggtcaaagtagatgttcaattatctaaacacaaacataaaaaagcccgacttgactgccctaaacaaaaacaaaagatttactatgagtaaaagaaatagttcctgatggagctctgaagcacaacggtgcaaggctgcccaggttgtcgctggtgcctcttgttacccaccatggatccagcgccgctgtctcacctcatcctctccggcctacatgctccaatgccctcaccgccctcgccaagctctgaacggccaccatcggtttccacatcgagcagacgcccgtgcacacgtacaccatcccagcagacaatctacagcactgataaatcgagttcaacctcgtcgagggcaggccgataaatgcagaataggttgcgaggtgatcaacagcttaattttaagcaggccaaacaacagacatgtttgttgctcagttataaagcatttgatggagcctgcaaagataatcacaagttatttgcaaaaaaaactttactatggactcgtgaaagcagaagaaagaacatgtagagaataaacaactgtggcatataaagtctgcaaataatagtttcttttatcgccctactgtgtgcagagcagcaaggattgttgaggagctgttcttatagatgtacaaggtgatttctttgtagttttgagctcacaaagttatgaaatcgtaaaatgcttttacgaatgaggcttgcatgcacagtggattccagttaatactccctctgggtaaggactaaggattcaggatctactagtacaactggcaagaaatatgatactaaatgacttatcagttgggatgtgctatcaataacaaagctgagtccagagtcccctttatatgtgtaactaccatacagtagcattaaacaagggcgtactagtcattctatagaatctaacagttccttaacttcaaatgagaaaagcgtactacattattcatattcttttctcaaatttcaacaaacttaaatgaagagacagaattaattaacttaaatgtaggcaagtagaatgatgaactgattatgtactaagaaaatcaagagtgctctcctgtgcaaactaaaagtaaagccgaaatactaaacgagaacacaagggtacatgcagggtgtccaaatcatcaatttggaacttatttaacaaagagcaaactgatcagcatctacatagtgcttctactgaaactgtgcatcctatattcctaatttacaccgagacatcaagggtacaacctatgtgcttaatgtcttgcttccatatatagatcctttagtgtaatcgatagttgtatggtaaaaacttttgcatggctactgttgtgtcaacagtagattttgctgcagaacagggtgaccagataattgcagtataactatgtgtagagtatataagcacatgtttttcactattcttggacctacctacaattcagaaaatgcgtctctgcttatgcaagttagcaggagggcaggaagatcaataacctgtttcagacggtcatcgatcttggcaaatccaatcccaacagaccctgaggcaaagaagatgagaatcagcttgcacaaccatagagtttggtcacgagtgtaactcttttttatccccatagaggtaagcattctttcaaagaaaccatggtctgccataaggcttgatttgtaggcctcaatgtcgttgacgagattggcatgaatggcagcttcgatctcgtcgaaacggtcagagggcgtcttttccagtttagagagctacaaagacacaggtgccaacatgaataccgacggggtatgccatataacaaccgattcaagaaagcttaacattcaactgaattatattgcacgatcaatcagaatgtttcgattcagagttagaattaggctgtttcaaatcacaaccactataaactaaattttcaagcattttttttgtttataatgacataagaattaattcttaatatggtagaaaaacgcatacaactctaatattaaaaaggccgaatttatcggaaaaggagtatccacaattgattgattatttaggagtggaccataaaccctaatgctaaaaattagggcagaggccctcaaaattccagaggtccgtcacttgaggagctcgattaggtcgatgagaagatggagacggggcgcacctcaacttcgccgctgggacgacgggcctgcggaggcgaacggggatcgccgtacctgctcggcggcagcgacgagtggacggcgcgggcaaggggtagaaggcggtggagggtgttggttgtcctggccgctgccattgacgccgccgacgtagaacacggcgaggtggcgccgcgagaaacccgccatgatcgcagtcgtcgcaagggggaagccatcctttcctcaccctcttcggctcttccccgacagggggaagtgatgactcaaaaaaaaaaaagttgagatatcctaacgggactagctattgggctgtccacagtttttgaggtccagagcagtcaaatttttgcacctcacgatctgcaatcaatgggttacaggaaacgggtctggaccagctgaaagcatagaaccaacctgtttaaagtgcgcgggcccgttaagaaacactaaacatgccaatcttttaaataaaaaacaaaacatacctacaaaacaaaagacccatcccaaaaactagactactcagaatttaattactaagcccatgaagagaacaaaacacaggcccagatagagatcaacttgcatatcaagaaagaaaaagctcgggcatcacacagccaaaaaaaaggattcgaaacaagaagcagatctaaaagaactcaagaacacagccgaaaggagaagaaaaaaagagatggaggaaaatccaagaaatgaaccaacatctgctcctccaggttgaatttctcacatacttttaagattacgttgcaatttcagtttttttcccaagaactcttcacccccatctcattttcttctgttcagcatttagatctgagcatcacaggcaaaaaaatcagtcacatttagatagatagaaaaatgctaattcaggtttcatctaccatgtacacttagaaaacagtccaacaattaatcttgcaaatgataaaatatgaacgacataaactcccaaaaaaagcagttacaaagctacctgggtaacaaaactaaccctagctagcaactagccgatgtccagtagttttaatgctcttgcatcatacaaaacactcttgtaactgcttcatgtaactggataactggattatcacactctgatgcttttgcttcttttttacacaatgatacatgcaccactaaaaaatcatctttcaacacaatgcctaaaagctgcatacaacttaagcaaacaagatgaaaaaagactagtgacataggagctcatgctcaattccaatgcatgccctgtaacttccatgtaactaccatgtaactgctatgtaactaccctgtaactggcatgtaactacgctgtaactgccatgtaactaccttgtaactgccttgtaactagggtgtaaatattatataactagattataaactgagctaattttgcaggggcaggaaatatgacactctatgggcacaccatgttgtatgatgagcaccaaatgatgtcagattctacgaggattgtgagtcacatggcatatttttggaaaaatatctacagaaattactcagcatgcaaaaaaaaaacaggtttagattgtaatgcacaaattcttgcaggggcaacaatgtaccttcacagggttgatgcacgaaataatgcaaactccaaaaagtgctataaatgctgatcaagattatttgggcatgtccagagatatcttacatactccagctggatttgaggtgaaaaatgaaataatctttttggttaaaaaactttacataaggtaacatggtatttagatttgttataattccttgatattttatcattgtagaactcaatgataatgacgagcaataggtttcctgagaactatgagcaaatgggaggtgaaatagaacaaggaacacaggtgaccaattcgcaacagtacatgtcaaacaaaaaaaatatttatgtaaaattatgaattttaatctgttttgttatcaaggcaatttgtgatcaatgggcaagcaagaatatagaagaactatacaacatcaacatgaacaatcagcagggattatcttctattatcaagacacttgccagtcgatggagcaaaaaagatatagatgaactatacaacatcaacaacacgcatcaggtaataagaaaatcatacagattataccatatgatcgaaataagtatataggtgtggaaaacattaagtatttgttacttacataatgcaggttgtaaatggcagcacaccggaagttgaaaacaatgtcagcgcatcggaattggaaaacaatggcaccacatcgaacaaccaggatgatgaagacagtgagaaccaaaacacctgggcatttgaatcaaacaatgaaacctctgaggtaagaaatttcttaatttaattaacttaaaatataaaaaagtacatcacacaatttagtgatataaaaaaagaatacttaaaagcacatggcaaaatgcagggacaataagctcacactgagaactcgacaattgatctggtggacaaaattagagctgatgaagaagaacacagagatcaggttgtggccacagaaccccagatgcaggaaaatagcaatccagagactgaaagtaatcagttgataactgagcaagatatagacaattttttggaagaagatgaagagagcaccccaacaatagatagcaaacacatgccacatattggaatgcagttcaaggattacaatgaggctcatgggtttttttaacttttatgcttatctggttgggttctcagttgctattacacacacgtatagaactataagcaagaagagaaacaacgagattaccagatacacatacaaatgcaatttacatggcaagaatgaggataacaacaaagacttagaggagcagtttcagactgagaggcaaactaatgttctgataaggtctgactacaagcgtgtaatggttgttaaagagacagtagaaaatggaccgtggaagatttcgaggttagacctgactcacaatcaccctctacgcccgaatgaacaaaaaaaaagttcctccgttcacacaagaatatgacagaggaagagaagaggctgattagtgttagaatttcaatggttactctcattgagaagaggatggcactagagatggggcaattttctggttttctttattcacaaaacacaaagccataccttcccgagggaggttggatacatatatatatatagccatagctggctggatggctgctagctaattgctgcccacactagtctaaaatttgaacgcgatgctgtcctagagagcatccaaactaaataaagcataaaggagatgctagatgctgtcctagggaagctaaaagcaaaaccgaaagatgctaaaagcaaaactgaaaggatgctgtcctaaaaggggaaaaataacctaaaagcaagagaaggaccacaaggaccaaagaccacaaggcttattccatcattctccccctaagtcttgtgtgtcgtcttgtgggaaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtggaaaacgggggtctttgccagggccagagcggacttgctgtccaccctgagctctaccgctccagtgtctctgccgaggagatcaccaagcagtcgagcaagccagagcgcctggtactcagcctcgcagctggacagggccaccacctgctgcttgaccgactgccagctaacgaggcactcgccgaggaagaagagaatcccgctcgtgctcttgctggtgtcgatgtcgccggcgtggtcgctgtcgctgtacctgaggaagtgtgctttgccaggacacctcgagtagtagagaccgtggtcgagagtccccgcaatgtagcggatgatcctcttcacagcctgctggtgctccgtcgtcggtcactgcacgaaccgactgacgtagccgacggagaaggccaagtccggccgtgtgtgggtgaggtagcgaaggctccccacaaggcgccggtactgtgtagcatccacctcctccgccgtgctgtcgtggctcagcttcagtctctcctccatcggagtgagagctgggttgcaatcggtgagcccagccagctcaacgacgcgcttggcgtaggcggtctgtcgaagcgtgatcccgaagttgtcctggtgcacttcgatccccaggtagaagaagagaggccccagatcactcatctggaaggtggccttcatctcctccttgaatgccgccacctccgcatccttggtgccagtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgctggggagcacgaatcccggcggctggtgcacgtagacctcctccttcaagtcgccgttcagaaatgccgacttgacgtccatgtgatggacaccccagaattactgagtagccagcgcaaggaggagtcgcacggactccatccgtgccacgggagcgaaggcatcgtcgtagtcgatcccctcctgctgcacgaagccgcgtgccaccaagcgagccttgtgcttgacgatggctccggcttcatccctcttcagcttgaacacccacttaagggtgatcgcgcggtgaccacgagggaggtcagcaaactcccaggtgcggttctcctgaaccgcgtccatctccgactgcatcgtggcacgccatgccgcatgtttctcggcctctgcaaaagacccaggctcaccgtcatcacacgcaaggtgcaactgcgcctctaggtcgcgaggcaccagtcccggcaccggctggtcgctgagaagatcttccatcgtacggtaccgtagctgctcgccgtcgtggtacgcgtcgatgcgctccccgtcgtgggagagtggagtagcgaactccaccgggctgcgctcaacacgagctggcgtcggagtagacgtgcccggaggagtggctgttggtgctggagcacgtggggacaccgactggggtggtgtcgacgaagagctcgtcgtagtcgaagtcgttgcccgaggttgtgttggtgttggagtcggtggaggctcggggactgggtagacacgctcggtgaagaagagctgcctactcccccagctccctcgaagtggacgtactcgatggtgaagtcgtcgtacgtcggagtcaaaccatcatccaccgccttgtcccatacccaccctcgcccttcgtcgaacactacgtcgcgcgctgtgcgcacacgctgtgtctccgggtcgaggatgtggtaggccttcgagccctccgcgtagctgatgagcacccctggggtgctcttgtcgtcaagcttgccgatgtggccaagctccttggcgaacgcgaggcagccaaagacccgtaggtgggagaccgccggcttgcgtccatgccaagcctcgtacggtgtcctgccatcgagggccttggtaggcgagcggttgaggatgtagacggctgtcaccaccgcctccccccagaagatggccggcatccccctctgcttgaggagagcccgagccatccccacaaccgtctggttgtgccgctcaacgacgccgttctgctgcgggctgtacggcgcggtgtagtggcgctgaatgccctcatcaacgcagtacaacgcgaattcagccgccgtgaattcgctgccgttgtcggtgcgcagcacgcgcagcttgcggccgcactccacctctgcagcggcctgcgcgcgcctgatggcatccgcagcctctcccttgctgccgaggaccatcacccacatgtagcgggagaggtcgtcgacgagcagcaggaagtaacatcgtcctcctggtgtggccggtgtcactgggccacacaagtccccgtgcacgagctcgagccgctccttggctcggaagctcgtctgctggggaaaggagagccgccgctacttcgttaccatgaagacgtcgcagagctgctccacatggtcaaggcacggcatgcctcgcaccatctccttggcactgaggtgcttcagggcctcgaagtggaggtgcccgaagcgctcgtgccactgccatgcctcgtcgtcccgacgagcggtgaggcaaactggttgtgcgacctgcgcgccgaggatgtagagtcgattagtgcctctggttaccttggcaagaaggcgacgacggcgatcccaaatcctcatgagtctgtcctcgaccaacacgcgtgagccgttctcatccagctgtcccacgctgatgatagaattcctcaacgcggggatgtagtaaactccggtgagcagcctgtgctcaccggacttggcggtgaaggtgacggagccaacgcccttgatctccacgccggaggcgtccccaaacttgatggagcctcggacgccggggtcgaactcggtgaagaactcccgtcggccggtcatgtgatgggtggcgccggtgtcgaggtaccacccatcagccttgttgttgctggagctgttgcagagagagacgagtaccttcggctcatcaaggtggaggaaagccgctgcggccggtgccgctggaggaagctcgatgcttgcgtgtgccaggagcagagccggctcttcctcctccacctgtgcgacgtgggcctggccacgtcgtggctgtcgacagtctttggcccaatggccaagcttgccacagttgcggcaggtgtcgtctcgtgccggcttgtggttgctggcggcgccgccctgggcacctctgcgagcgccaccctcggcgcgtcttcgcgcccaccgcagctggacacctccgcatgccttgcgcggcttgcggccgcctatcgagggagaagactccccctttcttccgtcactctgagaggcctcccactgctcccgagtgagatggagcttcccgccaatggtgataggccccgagagaggctgtggctcatcatcgtcgacgaccttgaggcgacccaacgcctcctcaatcgacatcgtggagaggtccagcagagactcgatcgagcgagcgatctgcctgtacttctctgggacgcagtggaagagcttctcgacagctctctcctcgtcgtaggtgtcgtcgtcgcactgcaccatcttctgcaaaagattgttgagacggagggcaaagtcatcaacatccttacctggcttgaaggccaggttctcccactccttgcggagtgcctgcagcgtggacttgcgggcgcggtcgctgccgatgcgtgccgcagcgatagcgtcccaggcctccttggcagtccgcttctgggaaagcgagaactgcatctcgggcgggactgcagtgatgagggcatccagcgcccgtcgatctttgtcgtagtcgacgtcgccgtaccagactgcctcccacatgtgtcacacctggagcctcaccctcatcaccgcggcccactcgatgtagttggttttggtgagggtaggccaccctccgccgggaccaaagtccctgaccaccgtctgaacgccgtggtggccatggcgccggtcaggggagggagagccgcgctgcctgcgagggccgcgctctccgtcgaaccagccacctccaccgggagcgccacggccgcgcgcgcgctcagggctggcgctggcacgcctgcgcccgtctgggttcccgtcagcggccgtgcggtcccttgggtcaccgccgccgccgtgggggtgggctgctgcccaccgctcagccccgctcccgcgcccttcctcttgccagctcctcaaactccctgtcggcggtgatgtcaccggcgatggagccgttgatgctgctgcgcaaggactcaacctctgcctccgccgcacgtgccgcatcctccgccgcctctgcttccacctccgcgctggcagctgccaactccgctgctgccagtctggccaccctcgctgctgctgcagcggtctgagccgttgctcacctgcgctcttctgctgcggtgagctcgacgtcctactgacgccgagtgctcaaggcgaccgaacgccgagaccgaacgtcggacatggcgtgcctccggggggctgctgcgtggagaaggggaagggaaaggggaaggaggagcagcgggtgctgctgctgctgctggctgagagctcaaccgagcttggtaaggggtggaacacgagatgttttgcctacaggaaagtgtggctctgatactagatgttagaatttcaatggttactctcattgagaagaggatggcactagagatggggcaattttctggttttcttcattcacaaaacacaaagccataccttcccgagggaggttggatacatatatatatatagccatagctggctggatggctgctagctaattgctgcccacactagtctaaaatttgaacgtgatgctgtcctagagagcatccaaactaaataaagcataaaggagatgctagatactgtcctagggaagctaaaagcaaaaccgaaagatgctaaaagcaaaactgaaaggatgctgtcctaaaaggggaaaaacaacctaaaagcaagagaaggaccacaaggaccaaagaccacaaggcttattccatcaattaggacgctaaaggaatgcaacataccaacgaggagtatgattgtgatcctgtcatttctccgtggagggttgccatcattgccctacacgaaggaggatgttagcaatgttggtgcatcgattaactttgaaacaagaagcaaggatatgagtcaagtgttgtagtatctgaagaaaaaagaagcacaagacccaggtttctattacaagctcatgctagatgagaacaacaaagtcagaaatatgttctggacagatggcagatcgacagtgttgtatggtcaatatggtgattgtgtcagctttgatacaacttataagacaaacaaatatgacttgccgtttgctccatttgttgggatgacagaccatggaaacacatgtctttttgggtgtgcattcctaggagatgagacaactgagacatttaagtgggtttttgagacattcaggacagctatgagaggcaaagatcctattagcataataacagaccaagacagtgcaatgagatctgcaatagggcaagtgttcaagaaaaccaagcataggaactgcctatttcatatcaagaaaattgcagagagagaacaggtaacacattcactgacagtacaaagaaagatctatacaatgaatttgaagacattgttaacaattgtttgacagagcatgagtttgaaaccttgtgacacaaatgattgataaatatgagctgcacaatgtgaaatacttgcaatcaatttgggatacaagacaaagctgcatccctgtctattgcaagaatgactttttcccatttattcaaagcacaacgctaagtgaagggactaatgcaaggtttaaaagaggagttgggccaaggcatagtgttacaagcttcctaaaggaatatgacagaataaatgacactatatttgatacactgtattggaatgcctataactcaaacacaaaacaacccaaaaatctatggtcaggatactacatagaagagcaagcttcggagatgtacaatttaagcattttcaaaaagttccagcttgaattaaagaaatcaacaaggcttcaggtgacagtgcttgaacatggcaaagcatacttggtattcttggctctaaatcaaaaaagaaggaatggagagcaaggaattatgtagttctcacagacttacaaaatgatgagtactcctgtgtgtgtgcaaagttctcgaaggatggaatcctttgctcccatatcctgaaagtaatgttggacctaaatgttagcaaaattccgaacaaatacatcatagaaaggtggaggaagaaagacaacaacataacaggtctattcagaggagaatcaagtaatggacctaatgctatgctaatgtacaacgtgctctcgcaaaaaatgtcagaattagcatcaaagggttgtaagagaccagagatatatagttacctggttggagaagtggagaagttggatagcatagtggacagcatgattctagaagcccatggaaatcacacatgccaggtccaaagtaatgcaacaaacaacgctgttgttgaggggcaacaacatgggaatctgaatgatgaagaggaaattgaagacccagagcaagctaatacaaaaggcaggaaatcaataaggcagaaaagattggtggaaaagattatggataaagaatgcaaaaaatacaaaggcaagagtaaggggaagaataaaacattgatcttaacttttccacaaaattgtcgatttccagcaatacagctgataaaataaatataaatctgttgcaggtggccaaagtaatgagaatcagttgaagacaaagagaacaagtaatgttgcgcaaggtgggactgcttgtgagatgcaaccaaaaccaaagaggcggaagaaaggacaggaaaacaacaccaaagaaataataggtaaaaacagggcaagaaaaatatgtaactagaatgttctcatgtaatagttagggcaaaaaaagcatatatcttgttgagagagaagaacaagacatcatgtaacagtggatgttctatatatttagtactgagtttgacatcattgtacttggcatgaaccatttcaatatggttgctattttctaaacatggaaaatattatgtggcaatactggaagcctcctaagaacattgtaacctatacatttcaattctacagagcaaaaatccagaatcttcaaacttgatcacgtttgccagcacatgacaaatttccctacaataaatttataaacggtagaaaattagtacaaaaataactctacgatgcacaaagaatacttaggaaaagaaaaaaaaagcaataagagcttactttactggcccaactctgaaccaaatgttcagtctcagtttgtagcattttgtttttttcgttgaagaaaatcttattagcaagctgaatgcggattatgtcgatgtcacttttgtcaaactcattacacaatagagatcttggagaccagagttcgatggatttcatcacaaatataccagaatcagcactacagagaaaacaacattttaaaaaaagttcagatagataactaaaagaataatgttctcaatagaaaaaaaataacagtgcaaatgaactaacttgttttcttcgcgaggaacaggtgggaaaaatatctcaaaactgttgaaatccatagcactttcttcagcttcatctcaagcattttgtagattgcttatctgaaagaaacaatatttagagaacaatatatagctacacataaaagaaacaaaaatatattctaaaatctttgaaactacttgattgatataacaataaatgtatgacaccataccatcaaatccatgattggatcaaaatatggatcatccttttcatgcaaagaatcaagaaatacaagcatcctgtcttttatatccaccacaaaaaggaaccaatgctccaggtaacaaatgggaaagaaaagctgtaagccaaaatagtgtttagcatgtgtttgtacataaggggcatacaaagaaaaaaaatcaaactagataattaccaaatcgcatttgtgcaatattcttaccattgctgctccttggaaggatttctcaatttttgctagctctttagagttaagatgtgatattagcatgtcctagaaatatatagaaggcacaataaaaataaaaaagaattcaatttcaatatatatagggaaacatacagggggatatagaaaaaaatgaggtggaaaaaggaaaggataacttacaccaatggaaggaaaaaagtagttcttcttggatttggatggatggtttttgtgaaacaaggactggcaaaatgcagagatcacaaatccattaacatctcctccctttttcaaagaattgccgaagttgcaaaatgagatgcgaacattatcaatgttaacagcatcctcgctgcagaaaaagatataaaaagcttcattgagagaaagtaatacaacaaaaaaatataataaaaaagaacacacgaattgagaaaaacaaaaaaaaagaattaaattactcttgatattcactatctgacaagctacaaatagcattgtaatatctgtgtgcattgtctgatacaacaaaacgacgccttggacaaacaaatgggtcacttctgtgcttggcaggatgtataatcctccttggcccatacagaggcactttaccaccagaagagctaagtccagaattgttaatacaaggaatcgacgcatgagatgagtttgtcagctgcttagttgtattgcaaatgtcatttggtgagttctgggaaaaaaataacgcaaacaagttaagtgactatgaaagcagctaaaatactagagcaaaaagagaaagataatgttgtgaaagtttagtaaataactaaacattgataggtactatttaatggcgctgataagaatacagtggtggtgaagcaactatggaacttattgaaaatatatgaaaacacaccatcttttaaaaaaagagatgctctaaaaaatataaaaacaaagcagaatgtatatctaatggatatagttcactcacagttaaatcttggaatgttctcttcatgccaatttgagaggggttcagattagcatgtcttctataagtgttattgttcaatctggttcttgtaccaagtggtggagtcatataatcaggaccagcaaaagtggcaggcttcaataataaataacacgaattataatacaaaatatgaaatcacaaatataaatcaaaacaaaaaaaatatcaggaaacaaattggaaaaagaaaaaagactcacatttgcaggtgcttcattttctttgccatgtgtatgtgatttcaaagtatctggtgtgcaaacattctcgccaatattgtattcatggaaaatgtcaaatgcaagtttatcctcatcataaatgtgacctctgttgtcacggttgttaaattcagctaacctggacttaaactccatcgcaatttttgtaagaagagcaggtggttctgcacatgtagaaaaattaaattaggaaatcaagacatgaatacaaagaaatggcaaaaaatatacattagcaaaaaggaaaagggtgcagtacctttaattgattcactgccacaacttttagaatttggaggacacacagtaccaggagtacagaaagcttggcctggttataaatacagattaaaaatcatcataaagaaaaatggaagacattagataaatgtaacaaatcgaaaagataataagctattcatttaccttcacaacaacaatttaaactgccatcgctatgaacgatatttggagcctgcacaaaaagaatgttaattattgaaagcataacagtaaaaaaaatagctccaaaagattagtaaaaatgaaatactaacaaaaagaacggaatgcttacatcaataacattattgtctgctaaatcattagtcaagtgttccccgtgtccttgatcaagattggcatcaatatcaatatctgtaaaatggatatatgaatgtggtgatttgaaaatgaaagaaataaaaaaaatgtaaactagaatgattaatttgcaaaaaaaaaaaacaacctacttaccagcattcctatcagaagatgggtaatctttcccacaagattttggaatagcattttcagtaggtgtattagttctattttcagcagaagcattattgtacgcagcacgaacaaaatggctagcactagcatcaatcaaaatctgtaaagcactaatcaagacatcttcgcaagaattgttctttgcggcatgatttgctgaaaaatgagaatccatcaaatcagatatgctgtccttcaaatttgcaggcaaattgtctcctatagctgtatccaacttgttgcgaaatgattctgaattttgcacatgtacaggctacagtagaaaaaaataagaacaaaatttgatgatacaacacaaaaggacataaaaaataaagaaaaaaaaaccaaacagctatagtaacatgtaagaaaaaaaataccttatagtaacatgtatcagagaaatctttaagaggcctcggtccataattctcatcatcaatttcatctaaatcagagtaaatcttcaccatatcctgcttccaaacagctatacgaggaacatctttcggcacattttttgaaccaaagtcacgatgatcaagatacaaaatctataaaaaatatgaagaaatgaatgcataagcagcaagcacatcaataaaatttgaatccatgtagtaaaaaaagggaaacaatataataacttactgcccagatatataagcaaccaccaaagctattggtcttctgaaatttcttaacatagctcatcagccagtcatagacgaaacttgaccaatcaaaagaatgcaacatatcgacatcctcaaaaatatctagatactttatggatggacatgtggaagagttaggacagagaaaagtagctaaggcaacaatcagaaatgatataatgatgctgtcgtcggtcatatcttcattattaatcaactggtctccaaaaaaattcactgaaggcatgacagtttttccaaatttggataaaatgaattgtcttccatgttcatagtttttcccaaattctgaaccaccaattggaagatcaagaatagcatggacagcttctttgttgaccgggatcaccttgtcacccaacacaatctcagaagtctttaaatccacttttttcacaatccaagtcgcaattttttttggaataaagcttgagtcaaacaaaagcaaagaatgaaaaccaaaattcttaatcacaattttcttctcctcgggaagtttagacacaacttctgcaaaatatttagcagaaaatcttatgaatgatgtgtcagtcttcgaggcggcttttcctttatggatctacaaataaaaaaatagtaccacaattaaataacaacatacaaaaagaactagactccaagacaaaagatgacatacaaaattgttttctctaccttaggcttgtgtcgaacattcttagaagtactcactaattcctttttcatcttttgaatgacctacaaacaagtgaaaagtgatttaaaatcaaattagagaattcttacaacaataatgaaaaaatatagggaaaaaattttagagaacaagaggatcatacatccttcttgaaaagtgcatacaacattttatccaatttagtttcattgtgcgctcccttcttttttataccctggaagaaagacatacatacatgtattatacaacatgttataaaagaaaatagaatcatttattttttataataatatattccctaggagattgaaaaagaacaaataaaggaataacagtaccatataccttcttactgtaaagctcatgaagcatattgtcaaatccagatatattgagtgcttccaaaacctgcaaacaaaaatacaaacataatataatgcatttaccatagtttcaaaaaaaacagtgcactaacattactgacctcatcaatgtgataatcttcatctgaccctgtgcatgtgtcactttcagaatttatagagttaccctcagattcctcagatgagatgtcaattgttctacgtggcatctttcgtttgcaaataagtggcatctaaaaaaaatatgacatgcaaaaagtatgtaaggggaaaaataacttagcagcagataaggcatacaaaaaaaatactaaaaatgcatcatgctatctgctaacattaaaaagtacagagtacaaagtatgtacagaagtaaaaataaatcgtcaagcactattacaaaatataataattctttgtgtcctacctgtatacatgtacatgtgcataagggaaaataaaaaattcaattcaaatctaacaatagaaaaaatacatgattctaaagcacaaaactgtaaattggcacactgtaactaggttgtaactggactgtaattagtttgtaactaggttgtaagttatatgtaactggaatataattgaacttattttgcatagtgcaaccaaaaaaataacgctctgtgtagatgataattaatagtgactgttggcctacctatgaaggggattaagaacacacatgcagtagattaatatctcgtatgttgaaaacaaaataatatgcttctcataatttagaactgaccatcaaaaaccttaaccttaagtcccacacatttcagatccaccgaatagaggcatttatctaagtatatatcaaaaacagaaaacacagcacattgtgcaaagcattttttttcaaatccatcaaaaaaccccatttaagctaaatctcccaaatacaccgctgcacttaaaaatactgcacctatgattcaaaacaaaccgaaacctaaaaaagcaaaagtaaaaaaaatggaactgcatgccaccaaacaaatctgaacaaacatatcagaaatataagcaactgtgcatatctacaaaatattttgacaacctgaaactatatctacatttctgaaatataaacatgtattctgcaccgaagtgaccttggttttgctactgctgacacgcattagactgagttcatgcctaattatcttaagtttgccatagtctgagattttaaatgtacatgtcgactgaaactgtgcagtaccctgttcccaaaattcaaaaattcaaatagatttacgattgtgcagtcgtgtgatcccctgtccccaaattcaaaaataggccaattcaaacaggttaacaattgtgtagctgtgcaatcccctgttcccaagttaagaaacaacgccaactcaaaaggatttacgattgtgcagcaattaacagggaacagaaacacaaaacagaagaaaagcagtaggtgaatcaacagccataatttctcaaagcaacaggagccaagtattggcttgctgctaactcatttgaatcagcacagaagaattcagaacatgtatagaaacagaagaatccagaacatgtatagaaattttgtaaagcaaacaacacagcaggataccatctgaataattcggaagaaagcatgagcagaagtgcagaacacatgcagggaattgggtttaatttaactaaacaacttagaacatactgggacatacatctctgaaatgaaatgcttcaaatgtagaagaattcagacacaaacagggagttgggcaattaatcaaccaaacaacaggcagtatactagaaaaagttgcaacgaatgcagcattcagataaagttgcactaatgttttcccttctctattcaaatcacaccataatccaagcaaattgcaaccccaaacttgcacggttgcacccgatacaaattcatgaacaggaaaacatcgagcactgaaatgttgcaaaacctgcaaccagatctcttggactagaatcccaccattccaattaaccaaacgatcaagaacatactgctagatctgtccatgcatcactcaaacgaaaaatgcttgaaacacataagtcacataacatactaggggggatcaacccaaatgcatatctgaaacttttctgaacaaatgcttcagatgcaacgcagaacatacatactagggatcaatccaaatgggatgtctgcaaactatgcaaatatgtactgtgcagatctgcaataaatcaaattagcacgatacaatagaccatcagatctagtgaacataactaagaaagagcacacatatatcacggttcgccatgaagagaaagcattagcgcctccatccccagatccacgactatacatgcgggatgaaatcaacgaatcaaaccccctataaatctaggagaagaacaacaaccaaacctaaaacaatttatatggcaaacaccatgcgggatctaaacacaacatctaaaatgccccaaaaatgaaaccaaatcgagagcgaaaaaatcacctggaaattttagaagagagcaaggtaaaagcagatcagctacgggcacgatggacacgagtggatgaagagaagcacacaagcaagaaaaaccaccggcgccgagagcaggttctccgccggcggcgagaaaatcgtcgagagcggggtctccgcctcagcctccgcttgggtctcctccccaacgggaaatttctggaaaagaacagaactaacgcggcattatactgtttgaaaattaggaacagcgccaaacgggcagacaaagtggatttggatccaataacgaaatatcccagcacgaatcttggagccggatcgaacagccaacaaatcaacagtttttagcgctgaaaactgtcgacagataagtagcaaaaccgtatcctaatacaataaatctgcatatagctagtatagagtttttattgcattctcaaatctcaactgtaaaattggataagaagtagctatataactgccaatgggttgtactcgcagattgtatttgaagggtacaggggacgttgaaactagtgtatacacgagattgcgtcatgaaaataggagacaacggtttatactggatcaagccatctaaaaagctacggaatccgtcaactagaaagaatcctgtcgagtatcgctcaggttaacaccttgttgttaacgagatgtattgtccgctatggatcatttgattggaatgaaatttagaaccggtatacagcatcgagtctgcctggttgtcgcacacagttattgctgtagcagctcgaccacgacgtcaccaaactcaagctcgctaagaggctcaaatgagccggaccttggagggaatggaggccgcggcgacccatctctccctcgagcttctgcttatgcttcccttaagttgaagcacttcaccatatagcatcctcgagctctcccactttaccttctcggatctcgtgaaaattgatgggtttgggtctgagagatttagggatgtgtgcttatgacattcttggttcatccttgagttggcaatttctgtgagaatcagaaactccgagttgagaatggaacttgtgggcccgtcccacgtaaactaatgtagtattggatggcatatttcctattacaacgaatttgatcatacttctattcggatttgttatactagaaaacatcatatccaatactagtctggtttttagggaccttgagatttattccaaatccaaattatacaaaagaaaacaaaagcgaatccaaaacttcattggaaatactgtgttttccctctcatcccaccgtatcctaaaacctatcagaattcgaactatgtaaaaaattaaagcaattttacgatcatttaggaggtaccatgaggtaccactttttatattgtaaatttgatatctcctggtacttaagtactacgaggtaccaaattttacactaaaattttgtacctcatggtaccttcacagggattgcaaaattgctcaaaaaattattatcaatctcagtcaaaagcttatcactcggattcttggagtttctatggattggaacatcaaattcaaagctcagatattcatccaaatacccccaatatgcccattcaatcaatttccttttctaacatgtgtccctggcaatatgtgggacccgctccttagcccgcttacacaaggtccattgactcatggaccacaggctgatgggtcgtcccaagcggttctcacttccagcccacctagtacttccatccatctcatgcctattaaactgtaggaaagagtacacgcaaggtccctcaacttgttagctagatacagaatcgtccctcaaccgcaaaaccggacatccggcgtcccccaacttacaaaaccagtcacaataggtccctcggtggttttgaccccgattttgtcccacgtggcagctggctcagcgtgggacccacgtgggccccacatgtcaggctgccacatcagcctcctcctcctctctctctctcttcccctcttctctcccttcctcatctctctctctcccttctctgactcaaccggcgggaagaggagggcgtcggcggccggcgacgggtgacgcgacggcggtgatggtggcgacgggtgatgcggcaatggtgggggaggagctacgggcgggtgggcggcggggagaggcgacgcgcaggcggcggggaggggcagcgcgcggatgggcggcagggaggggcagcgcgcaggcggcgaggagtagcgcgcagacggcggggggaggagcggcgcgcgggttcccccgccggctgccggccacaaggcccacgaggcagaggaacgacggcgatgattcggcggcgggcgacacggcatcggcctcgtcggaggcaagcgcggcggccctaccctcctcgaccgtgcggcgcgtgcggccgccggggcacacgaagagggcccccgccgtgccgtcgaagtcgggcgtggagacggtgaggtgggcggcggcggcggcggcggcgggggtgtgaatgggaacggcagtcagcgggggaaggggaggggagcgaatcgagggcggcgagggagaccgggacaggaaggggagcgccgccgttggagaaggccggcgaggcagtggcgcgcgaagccggcggcacggagcgggacggggcggtggcgaacgacgacgacgacgatggcgacatgttcgaggaggaggaggacgcgcgcaactcctccctcgccgcggccgcacgcgcgatcgaggagggtggggccgccgcgctcgcctccgacgaggccgatgccgtgtcgcccgccgccgtatcgtcgccgccgttcctctgcctcgtgggccttgtggccggcggccggcgggggagaccgcgcgccgctcctccccccgccatccgcgcgctgctcctcgccgcctgcgcgccgcccctcctcgtcgcccgtccgcgcgctgcccctccccgccgcctgcgcgccgcctctccctgccgcccgcccacccgtagctcctccccccaccactgccgcgtcgcccgtcgccgccatcaccgccgtcgcgtcacccgtcgccggctgccgacgccctcctcctcccgccggttgagtcagagaagggagagagagagagagatgaggaagggagagaagatgggaagagagagagagagagaggaggaggaggctgatgtggcagcctgacatgtggggcccacgtgggtcccacgctgagtcagccgccacgtgggataaaaccggggtcaaaaccgtcgagggacctattgtgaccggttttgtaagttgggggacgccggatgtccggttttgcggttgagggacgattttgtatctggctaacaagttgagggaccttgcgtgtactttttcctaaactgtatgctaaaagctaaattggtaatcaacaacttactaatattttttccctctttctttttcctccatgtcataaaaaatcataggtgacatcttctccttagacactaacggtacgcaagtgtccatatccttacatttccttacagcatattgagtaataagtagcaaatgaataaacaccaatcaactagtggcaaacgagtaattttatctttcatattactcccctcaaaaatatatttagccaatgtgataatacttttcgagacaaatctatttatatcatttgatttggctgtaaactaagcattcgagaaatcatcgatggccgaaatcttaaaggataaatatattgtttttatcggagggagtattcctctacgatcttttgagacgtccggtgttcatgctcatcaatttcgcttacggagtagtactgaacaaaaatagagacaacggtattttattacggacgatctaggacaagaaaaccccccggcgccctccctgccacggcgcaccgcactgctaccgaccgacgggtgcacggcgcggacagcagcagcaacgtgagttcgtggtcgtggaccacccaccgaaagcgacgtctcaccagcacacacacacaccaccacgtcagtcggttgccccttccctttttacccatcacctcactccaccttcttctcacgcagccgcagcctccgacccccatgtgcgttcgttcgtttcgcgcgcgcaactgtgaagccgagccagacaaattaaaaacaagaatacaaaaacagacaaattaaaaaacaagaatacactcaaaaaccaaacacggttgagaacttcagatacatccatctaggtaagcgacggagaagccgaagccgatgcgttcgcttcacctgcctcgtcttcttctcctcctcctccgaagatcttgacggtcggccagttattatcactgcccgcttcttgcttcttgcagacttgcagttgagttaattactgcggctgtgcaggagaaatggcgtgttttggtgggaggagtatatccaaagtttggatctaaaacttcagtccttctccatcatattaatctatcatagtatactagttgctgctcctcgctgcttctgcgtctcctccacgagaccacgaccgacgcccccacatgggtctcatggtggtgtgagctgagctgcttgctgctcaagtggtgagaaggtagagagagagagagagagagagagctgagctgcaagaaaggctcacccatcgaggacaccaaaacaagtcaagaacgaacgactcgtgatccgtccatgggttgctctcctgtcaggcgcatgagattctgaggcggaggaagaggagagaaaggaggaagaagagcaagatagcggcggcggcgatgagctggaggaaaggaggaggaggggatggaggggtgtcgaggagatgggccgtgctgctctgcctcgggagcttctgcctcggcctgctcttcaccaacaggtaatcaatcaagagaatcccccctgctctccgattcttgctctcttcaattttcgaggatttgagctcagcttcgctagtgctgggtcgttgatttgagctgcgccgagctcaaagatctgtgccatttgacgcgcctctgcatctggggtgattggggggtctggattactgtgtggccatgaattcgtgttcttgatttttgcagcggaatactgtaaattggtaggagtgttcgtgttcttgctttcacgggggttgtttggtgatttggtttacctcgattacatcgaattggagtgtcaacgctctctgaacctcgaatttattacttaccgcattagattattggcttcacaagctgtgcaaatgatcccatttgaaatatgcacataatttgcttcctagacgagtttctgctaactggtgtatcctcacccaacattttagctttagcactccactcttcagtcacttccttctgcagaagcatgaccacattttgtggatgtctagttccattttcgcaaattcagctagtcttttcgcccattatgatgttattattacaatgatggtaggttaaaaagctgggccgaaagacctcccccgaggtatttcgtttaccaaatgtttcttacctattccccatcaattgtttcagaatgtggacactgcctgaggcaaacgagattgctcgaccaaacggaaatggagacgaaggcaacacgctagttgccgcggagtgtggtcctaaaaaggtaatgcttttcttcccattttaatttctctaattttattcaacactttattagtccagttcattacatgaagttagttttatagaagatgatactttctttctattgtaatgcagtgtatagagtaattgtcaatatctttagctgattatcatgtgtttgttagcaggtccaacatcccgattacaaagatatattgcgggttcaagatactcatcatggtgtacagtacgtacaggccttgtctttcttgagaatatttttgtttgcttgttgattttttttttttagttctgatcggtatttttggatgctttgaatgtagaacactagataagacaatagcaagcttagagacagaactctcagctgcaagatctctacaagagtccttgctcaatggttccccagttgcagaagagttcaaactttccgagtcaatcgggaggcggaagtaccttatggtgatcggcatcaatactgcatttagcagtcggaagagaagagattccatacgttacacctggatgcctcaaggttgttgacattaaaatctggaatatgtgtttcattaagaaaaatctgtttattccatcgcaaaaaagtgaaggacagtacttttgttcccctgctgaaaagaaaaggaacagtacttctatagttttattggcatgactcgataaactaacagacaaaaaacaggtgaaaaaaggaagaagcttgaagaagagaaggggatcatcattcgtttcgtcattggccacaggtacaaagaacgtgttgcatttttcagtactcagtagtcatggttccttattttgattttggtttctgttattgacaaaacaactcactcattccatgtcttccagtgctatatcaggtggaattgttgatagagcaattgaagcagaggacagaaaacatggtgacttcatgagaattgtaagacaagcacttgcttaattgcttattggtttttcatggatcgtatttatcaagtgactgtttctcctagaatcactgggaatgctatttcgcccccttatttattgtggtctaactttattcaggatcatgttgaaggataccttgcactatctggcaaaaccaagacatactttgctacggctgtttcattgtgggatgcagacttttatgtgaaggttgatgatgacgtgcatgtaaacataggtaaatctccatatcttttatgcccttctattgttcttttttgaacattttatcgatcttaagatgagaggaaagtgatcatatctgtgtgccgccatcatgtctgtatttgaagcttctctttgactcattgatggtcatcttaagtgtccattttgtatgtgtagaaacattaaccagggtttcaaatatttcgcaagataacacgcagctagtctcatcaatgcatatttgattcattgcatgtagaaagggcatcactgctatagacaattgattctttatgacattggtgttttgcttttgcagcaacacttggacagattttatctaatcatgcattgaagcccagagtatatattggatgcatgaaatctggacctgtcctaactgagaagtaagtgcatcacatggttttaactgttctttctgacaatgtctcctttccttttctcatgccctcaaaatttgctaagttttgttaacccttgtctccaggggtgtgagatactatgaacctgagcattggaaatttggcgaaccaggaaacaaatattttcggcatgctactggtcaattgtatgctatttcaaaagatctagcaacctacatatctataaacaggtgagataacacctgttttcatatttacctgtgtgcacatgcacgccttgttctcattgttgcacaaactaatgctgattcctctaatccaattgctagacatgtcctccacaagtatataaatgaggatgtttcattaggaagttggtttattggattagatgtcgagcatatcgacgaccggagactttgttgtggtactccgcctggtaagctccctacctcctatcttgcatttattatctgaagcttctcttcatacctagcaataccaaccggacgaacaacgtaaacatttgaaccgagtcacattttcgtgtcgtcgatcacagattgcgagtggaaagctcaggcggggaacacctgcgccgcgtcattcgactggagatgcagcggcatatgcaactcggaggggaggatctgggaggtgcacaataagtgcgccgaaggggagaaggcgctttggaacgcaaccttctagcgtgaccgaaacaaccggtcaaacaaaaaaaaggaaaaaaccggaagcacaagcaggaacttcctcctgcttatagtaggtgtgctgtacattggccacggtctgtttgtatgtaattcttgtgtagtttttagctgtgatgattcgtttctgtaactgggtctggatgaacaccgacgaagcggaccacaattttacgtagcgtctgtctgccggtggcggtgaaggaggtgggtataccagctgatattgcattctttggagaagaggtaaaatgtttttgagttttttgaggtggtcattttgtatcgatctcctgtactgtatactgtatatggctgccatgatgtatgaccaaaataaaacttacctgatgatgcttcatttcgatgactagtatagtagtatactaagatcactctttttttcttgtcatactgctgagagtaacaattcagggcatgtttggtttggtgccattttcaacctcacaaaattttgacattattaaattttggttagaccaaattaaacacactttaaccattactatcttaccaaattccaaaatttggcagttctacgaactatctcttaaaactctaccaaatattgacaaacgcaacaaataaaacaaagacaacgctatcaaattttgataatgccacaatgtgtcaaaatttggtatggttgatttgagcaacaaagtaaacaagccctcagtctctctgccatcatcggaattcaaacatgggttaaaacattatgaattcgcgctgaatttttaccaaactgcaaaccatcaaacactggcattccatttccatacactcttgtgactttaaaattctctcgacgataaaccgatagacacgtgagtgggcccacttgtcagtgacatagtgttatcattcgtgtaccaatttgctgtgcgcgcgtcgtggtttcatctccctctttttccagtttccctcccatttcgttcccgccatagttttccctccactactcgcttccccccgcctccttcccctataattatctccgccgccgccgccgccggatcccttcctcgctccctcccagctatctccggcgatggagcgacgccgcctccaccgcgccgcgccgcgagaggaggagcggatgcaccggttcctccgcccgggggcgctcgcgcggctcagggactcgaggatcgtcgcccgctggctccggtcggccgcggcggcgacgcgcctcctgccgacgtccctccctccggcgccgacgccgccgcaggtggtggccgagcagcagcagggcggcgcgccgcacttcgtcgtgccggcgagggggctcggcggcgcggggaggtacccgctcaggaggaggatgtgcgcggccaggagcgtcgtgttcctgccgccgccggccgcggatgcgttcttcgccgcgttcgcggcggcgccgccgccgccggcggatcttgtcagctaataaggatttgggcgtgtactgcgatttgtgtagatggttcgcgtgttcttggttttggttgatactagtaatcaggatttcgagtaggaaaaataacaagatttcgatctttattgtgttctcggctgaattgcagattgtgaattatcccaatccaaatgacaattctcataatgattacacctggcgcgattagatctgtgaattgcttgggtattcatagtgctgagtgctgaccagttcatcttccatctccctccaattcggcatttttgtcgggaaggttcataaaaaataaataaatttgtgcatgccttcctccaccataataagataagtaatcaagtggtcatgcagatggtataattgagatcaaccaggtgcgcatttgaaatgtacaaagagctcacaaatcctccatatcgaccatcacgacgaaatgttatctctgaacttttggacaatgtagcatcacattcacatttcattttgttacatccgatgctaatcctgggaactagtaggcaagataccgttggaacagaagtttgatttcttgtgcccttttacatggaaaccggccgtgacaatctgacctactttgactgatcatcatcatccttgctcctctgattgacagatcacaaaactcacaaatcgtactcatgcatcatcaatcaatcagtacaaaattcacaacgttaatatccctttttctgatactgttccctcctctttccttgtatgtatgcgttctcgtctatataaatcctacacgttgcacatgacacgtacgggctcgtcggcggcgatggcgaaggcggcggcggagatggacgtcggcggcggcgaggggaggaggtggaagcggacgcgggggcggcagaggatcgagatgaagctgatcgagaacaaggaggcgcggcaggtgtgcttctccaagcgccgcgagggagtcttcaagaaggccagcgagctgtccgtgctctgcggcgcgcgcgtcgccgtcgtcttcttctcccccgccgggaggccgcactgcttcggccacccctccgtctccgccgtcgccgaccgcttcctcctcggccgctcccccgccgacgccgcggcggcggcggcggaggaggaggaggcggtcgtgcgcgagttcaaccgcgtggaggagcgcctgaaggacgcgctcggcgcggcggcgcgcaggcgggacgcgctcgacgaggcggcgcgcgtggcgggcgtctggaacgacgccgacgtgcgccgcgcggggctcgccgacctcgtgtccatgctcgccgcgctccagagggtccaggccgaggcgtcggagcgcgtccacgacatcatcgtcgaggaggcgatgacacactacacgggcgccgccgccgccgccgccaacctcatcgactacctcgacgccggcccgttagtctctcacagccccgggagccacgacaccacgacgaagttgatcggcggcaacgctgtccatgcgccgccgttgtccttcccgccgatgataatgccgccgcctctccccccgcagttcagccatggatttgggtacactgacctcgccgccggctacggctacaaccttgaccacggccatggcgccgcctatgaaacggaagaatttcacaacgcggcagcatgcgacttcttttaaccagtgaaatttcattaggttttgattgataattaatctatctaatgttaattagtaagctgtttaaattacaattaaagcggccagtgtgtgtaattatgtgggggtggaaacaaagctgttagcgatattatcgcttgcggtgtttatctctttctgttttatccgatctctcctcctaatcctcccgattctgttgttataagtcggttgagtggttaaggtatggatgaggtctatatgtatacatgttccgtgattaatgaaatcatcgcgttgagctaatctcgctttcatggtatcagatacctccgatctaatcgcttccgctccaccctaaacctttctcctgccgccgccggctcacccttacgccggccctcatgtcgtctcacgacaacgccgctctctccgcggcgattacctccgtaaccaacgccgctacgtctgccatccgaaagacgctccgtcctgccgatgacacagtctctgcggatgatcgtgccgccgccgaggcccttgctgacgccacttctgctgctgctgtcaaggccgtccaggacgccatctctgccctcgtcgtctcgtcgtctgccacggcaaacacagcgtcgagcccgtcttccccgaccacggtgactgtcgacgcatcggcgcttcgcgccgccctcggtgttcctcaacccgacgcgccctcttccgctggcgcgcccgtcgaccgccccgaacccgacctgtcaagtctcttcgcagcgctcggtgttccgcctcctcaccagcatgacgagcaacccgccggcgccgcgtccggtggcgcgccgctcgtcgacgacaccgttgatgcactccacgctcaagctgtgtcggtcctcaacgttaaggctcttgttccagtcgtcctcgacctcggcgcggcgaactactctaagtggcgcggcctcttcctcgtcacgctcggccaatatgccctctccgatcacgttctctccgacgtcgccttccccgaccaagcgacacgggcacggatggactgcgtggtgctggcatggatttatggcaccatagctgccgatctcctggagaccgtgctgcagcccgtcgccactgcacgccatgtgtggctctgccttgagcagatgttcctcggtcaccgagaacaacgcgccatgcacgtctcgacggaattccacaacttcgtgcaaggtgacctcagcgccaacgactactgtcgtcgcctcaaggccatggctgacacccgcggcgagctcggcgaccccgtcaccgaccggcaactcgtcctcgccatgcttcaaggtctcaaccctaagtatgaacacttgcaaacaattattcccttgtagcgaccgtttccgtcgttcgtcgaggcccgcagccagctcatcctcgccgagatcaacaaaggtaacaagggatcctctgctccatctaccgccctgatcgccgccaccggcggcaaccgcggcaccggcggcatgaacccggcgcatgccacgggtttcgacaacccaaaccagaccagccaaggcggcggcggaaataaaggcggcggcggcggcaacaatcgaaaccgacgccctcgcaacaactccggcggcaactccaacaactctagcggcggcggcggtggttcacaagcgtctcaaggcggcctccagatcgtgcaagcccagggaccaagccagccacatgctcctcaaggctggcccacacctcagcacccatgggccggcaccatccagatgtggcccggtggcccacttctgcgctcccctggcatcctcggcccacgacctcagttcgcaggagcggcactcgctgggccttctgccggcctcccgcaacaggcctccagcgcccagccagccagcttctacaaccaggccggccttcttccgacgccttcgccacagcagtcggcccagccttcggcctggtacggcgctaccggcccgacgcctgcttgggaccagcaaacccttgctggtttgttccaaacaggaaccctcacgacgcccgcctccactgaccggtacatggacaccggtgctacttcacatatgacttcggacaccgatatcctatcctctcccacctacccaactcactctaccccctcacacattattgttggaaacggttccctcctgcccatcactgcaaccggcgatgcctcttttttttatgccaaccgaatatttcttcttaataatgatcttgtttctcctggcattataaagaatctcatttctgttcatcggtttgtcactgacaacaatctttccatcgagtttgacaagtttggtttcactgtgaaggatctttctaccaggaccgtggtcgccaggtgcaatagtttcggtgacctttactcctttccggcgaacttcttcaacaccatggccagctcctttgccgccagcaccaccacactttggcatcgtcggcttggacacctcggtcacgaggctcttgctcgcttggcccactcctcggtcattccttcacccaaaggcggctcctccaccatatgtcatgcttgtcagcttggtcgtcacattcgtttaccctttactacattgttttctagggctaagggaaactttgagttaatccattgtgatctgtggacctctcctgttcccagtgtgtcgggttttaaatattacctagtcattcttgatgattgctctcactatgtttggacgtttcctctacgtttgaaatccgacacttttaccacactttctcatttttttgcctatgtcaggactcagttttccacaccgattcgcagcattcaatgtgacaatggccgtgagttcgacaactccgccgcccgtaccttcttcctcactaacggcgtcaccatgcgcatgtcctgcccccacacctctccccaaaatggtaaagccgagcgcactctccgttccctcaacaacattgtacgctcgcttctctttcaagccaacctccctggctccttttgggtcgaggccctctacaccgctacctatctcatgaaccgccaccccactaaaactctccaacgccacactccctactttgccctccatggtgtccacccgtcttacacacatcttcgggttttcggttgccgttgttatcctaacctatccgccaccacacccaacaaactacccccccccccgctccaccatgtgtatctttcttggataccccagcgatcacaagggataccggtgttttgatcccattactaacagggttattatttctcggtatgtcgtgtttgatgagaacacgttcccctttgctgagaactctactgttgacacatgtactactgatctcttcttcttggatgattttactgctccagtacaggcgccgatcggctccggcaggcccagtggcgcgcggcctgggccctctccctccactcggctgcttggtgggccctccactacaccgcctggaccaccgcctgctctgcccactagcccacggcctgcgaactctccggctgtctctgggccaccctctactccaacaccgacaaggttggcctagcacacggcgctccaggacttccccagcacctcggccacctcggtcgacctcatcgatgctgggccgcgcgctcccccaagcacggccacgtcgccccatgacggatcttctagcgcttcatcaccgtttctaccgccgctcatgattccgacccgcgcaaggagtgcgcgcgttcctcttccacgcccgctcatcaccggcttcggcaagtctccggttgacaacgaccacggcatgaccaccagaggcaaggctggtgtaccggtacccactacacgtatgaaccttcaagccgctaccctgtctccgatcccgcgcacctaccgtgccgcgctcgctgacaccaactggcgagacgccatgcaagaggagtactcggcgttgatggccaaccgcacttgggatcttgtccctcctccaccaggcgccaacattgtcaccggcaagtggatttttcgacataagttccacgccgatggcagtctggaccgctacaaggctcgctgggtacttcgcggtttctcgcaacgccccggcattgacttcgacgagaccttcagccccgtcgtcaagccggccacagttcgcaccgtcctcaatctcgccgtctcccgcggctggcccattcatcagcttgatgtgaagaatgccttcttgcatggtaccctggccgaggcagtttactgcatccagccatctggtttcgtcaacactgcccaccccaactccgtctgccgcctcaacaagtccctctatggtctcaagcaagcgccacgggcttggtacaatcgctttgctaccttcttgcaatccattggtttcattgaggccaagtcggccacgtctctcttcatctatagacgtgacagcgatgtgatatatcttctgctttatgtcgacgacattgttcttactgcctcgtccacctcgctccggcgctagaccatctcatctatgcagacagagttctccatgaaggatcttggcgagcttcatcactttctcggtgtttcagtctctcgtcagtcctcagggttgtttctctcacagcggcagtattgcttggagatcttggagcgcgctggcatgacagattgcaagccctgcaacacccctgttgatactacctccaagctatcctccacagatggttccccagttgcagatcccaaagactaccgcagccttgcgggtgcattgcagtatctgaccttcactcgccctaacatacagtatgttgttcagtagatctgtctacacatgcatgaccctcgcgagactcatctcaccgctctcaagaggatcttacgctatgttcgcgacactacagatcttggactacacatccgccagtcttcttctcatgacttggtggcctattctgatgtggactgggctggctgtccagacacacgcaagtccacctcgggctacgctgtgttcttgggagacaacctagtctcctagtcctccaagcgtcagaacactgtctctcgttccagtgctgaggctgagtaccgagctgttgcaaatgccgtcgctgagacctgttggctgcgccaactcttgaccgagctgcatgccccgccagtccgagatactcttgtgtattgcgacaatgtcagtgcagtgtatctctcaactaatccagtgcagcatcaacgcacgaaacatgttgagattgatttacattttgtgcgcgagaaggtcgccattggatctgtgcgagttctacatgtgccaaccacatcccaatacgccgacatcttcaccaaggggttgccaactcctgtgttcacggagttccggtccagcctgaacgttcgctctaacaacgttccggctgcggggaggtgttagcgatattatcgcttgcggtgtttatgtctttctgtttcatccgatctctcgtcctaatcctcccgattctattgctataagtcggttgagtggttaaggtatggatgaggtctatatgtatacatgttccgtgattaatgaaatcatcgcgttgagctaatctcgctttcaaaagcggtctaccagattacgccttcgcttttgaaatacgtatttgcggacgagatgagcgtttgcaatttccatggcgccgccgccgtcgccgccgcacgccgcggcgcttccggcgtgggcggcggagaacgcgctcttccgccgccaccgccgcctccgcccgctcctcctccccgccgcttccctccgcgccttcgctcctcttctctcccactgcatcgtctccggcctcgcgcgcaaccccttcgtcgcctcgcgcctcctcgtcgcctcctcgcgcctctccctccggttctccctcctgctcctctcccacctccccgcctcctccctctcgcccttctccttcaactccctcatccgcgcctcgcctccccgtctcgccctccagctgttcgaccaaatgcgccaccgaggcgttaccacggatcgttacacgctcccgttcttgatccatgcctgttcttccggtgatcgtcctctctgcgaatccctgcacgggcaaagcctccgccttggttacagttccgtgctcttcacgcagacggcgctgatgaacgcctactttgcttgccggtttgaggttgccgctcgcagggtgtttgatgaaatgcaggcgaaggatgtggttgcatggacgggcatggtgtcgggatacgtggactctgggatgttccttcgaggtgtcgaggtatttcaggagatgagaagctgcgaggaggctgttaggcctaatgtggcaacggttgtgtcggttgcttctgcgtgtgctggactgggctccctggagtatgccaaagggttgcatgcatatgtggagaaggtggggttggaaggagagttgattgtgaagaattcgttgatcgatatgtatggaaagtgtggcagcattgagttagctcgtggcttgtttggtttgatgcctcagaaggacctgcattcatggacggccatgatttcagggttggcttctcatggccatggcaaagaggcagttgctttattctttagcatgaaagaggcgggagtattgccagattcgactacctttgttgtggttctttctgcctgtagccatgctggattggtggatgagggaatatctatcttcaattccatggagaatgagtacaaggtcacccctgatatcaagcattacggttgcatggtagatcttttcagcagggcagggcttattgcacgtggttatcagtttattgaaagcatgccttttgagccaaacttggcaattctcggggcattattgagtgcttgcagtatcaacaatgaattggatattggggaactagtgatcaagaggattgagtctgttcgctcagataaaggaggtgctggtgtgcttctgtccaacatttatgctaaccaaaacctgtggcatgaagttgattctcttagaaggaagataagagatgacactatttgcagaaagccacctggccagagtgtgattacatcagatgtttctttcatggcttcttgagcagggtttcaacacatccactctcaatgtagcttctctcattattgggcaggtaaggtaactagtgatttttctaaaagtatatataacctggagcatattggataatttgtcatcttcgatttgtttcaagattcttatggtttgactgttaagagagaaatgaatgttaagttgcttaattaaatactagccctgttctacaaacttgaatttgagtgtagtgattggttaattagtaccttgatccatgtaaggcacccttgtattgataagtaattaatgttaactttggaacggacaggtttaattgccataatcttctgtacttcgatagagataacaagacaaaattcttctaacaacttagggaggagttgtcaagcttgatataggtgtacctaccttccttgatcatcatcaacaagctctggtggtacttggtgaaccctaagatcgtagctgcaccgttttacatgttcgattatttcatgtgtttagtattgtattatgctcctgagcttttacttagctagtctcccaagtacttcaatatttttggtattggtttgaaaacgcatttggttacctagtatctccaatcgcttatcaattcccagtctattttgcttcaaatgcagatccgataacaaaacctacctcactgatccgccattgccgtcgctcttgattggcaaacgacacatttctgaagcagcatggaagcacatcaacttccccttctgtgttggaagaacaagaaatatgccagcttattcagtctccgtccaaaagctagtgcatactagagcgcctctactcccaggtgataatgctttcttgcagaaatactaccatgcataaattgttgacaaattgcaatgctggtgtttatgcattcagcaaagcgtgtgggggccggatgatgtcagtgaaagcttatttgctcctgcaagacccacccacatgccactcacgaaagaaatcaagggaggaatgtcagcggcagagaggcgcagaatcttacttttcaccggcaagtagttttgttggttattttggtcgtcaacactaatggctggtttttgcttactagtatatgatttggactcttgttggttgatgccggatggatggtgattggggtaaaggagcagctaccctggccctgcaacttccaccataacaaacatgagtagaggcagagcttccatgggttcttgggagaagcttctcttgtgcatgcactgaaccaacaagcatatcatatcggcttatatattattctcctgtaactttccagaatcttatctaacctggatatcacaacactgggcatatatctctttctccatgttgtggcaaaggaatctggggcaaggaaaagaagggagcaagttggggcctgtttagttcccaaacaaaatttttcacgtcgtcacatcgaatgtttggattttttacgttgtcacattgaatgtttgtacatatgcatgaagtattaaatgcagaaaagaaaaaccaattacacagttcataaggaaattgcgagacgaatcttttaagtctaattgcgtcatgatttgacaatgtggtgttacagtaaacatttgctaatgacaaattaattaggcttaataaattcatctcgcagttttctggcggaatctgtaatttgttttgttattagattacgtttaatactttaaatgtgtccgtatgtctgatgtgatatgtaggggtaaatttttttttttaccactaaacaagcccgtggaaaagctagcaaaggcgcacgcaacgcaaggcctctctgctcggctttgcttcctcgcgtgggaggctcggattcgcctgccacttgaccggccggcaccccaccgaggtgtgtgtgtacaggttggctgggttccctcccgtgtgcgtgtggtggtgcggctcttcgcgttgacatagagcctttattcttttccccgcaacctttcctcttgaaaaagaaaagcgcaggagatcttctaaaaaaaagttttgccttatttagtgacagacacgtatctagattttttaaaagaaaataatgaattatcattcgatctttgctactcagggggaaatccacgagaaatagtttgcgacactaagtgtagattgcaatactgatctggaggaaagagctaaagagaacctaagcaggcgcgggcgggcgacgattttatcaccaggttgcagcacacgtctcaagacaaaagcgtcgggcatgagagagatgctgcagcatggggtcaatgctgcatttttttttaataatgatgtgaagtgtgtagggcccaacaatacaatgtatgtacgagctacaaagtgagttatagatgaactggtataaatataattggagccaactgactactttattattgaccctgctctaaatagtgatgatctaacccccttccccccaaacaaaattcttcctctctctccttgcactcatattagatctgctattgtttgctacacacatgtaaatttattagtgaaacattactcgagtgacatatatatagtagggcatgttttgtgaggtctgaatgagtgtttctatgtttgttttttcaacttttaaatctcgaatcgtttatttaagagggcaaatgggtagtctttgttgcaatgtacacatgctcaatcaaataatgcacaatttgcatggcatgacataaaacataaaacacagagagagatatgaagtggtcatgcatttttagggataagagagtgtggttcacatgtcagtgacagagatgaagtgtgttgaattggtctgtcaatttttaaattgtgaatctgacttgaatcttgaagaaatatttctccgtggggatcaaccaatttttaccgatctcgaaaccaaacaaatctgaaaaagtactctcttcgttctagaaataaactcaacctaagagagattcatatttcgttgttagattttttttttgtcaggacggacggaagggagtatgtttgatgtgaccttctattccatcccagaaaaaaacaaatttgagctatgaacctggacacacatatgttaacctattgatccaaacacatgtttatcgtggagtgccacagcctccctcgcggcgcacggacgcggcctcctcgtgtctcgccgcgaccaacctgccctctttttggccttcagatccgtctcggatcgcctcgccgctctcgttcgtatctctcctcgcgcgtctcctcctcttcttctcccccacgatttcgttcgtctgcccggacagcaccccggatccctcgccccgcgccgcctcctcctcgtaagtctcgctcttccattccccccctctcctttctccctttcggatgttcgcggaacgcctcctccttccattgattctcgacagaggacaagaaccttccttcgtgtcggcttcttcttcttcttctttgctctgctgttcgtcgtagcttcgctcgtagccggggggttcgtcgggagggattctctggtaggtcataggtgggtgcgaaggtttacgccgcgtgcagcgtccggttcttgcctgccttcctgcgctttggcatcagatgcggcaggagatggtcggtcggtcacctgtgaacgctcttcgtttcgccatttctgatagatatattgcggggttccttttccttgtgtttggttctctagcttcttctctcttcctgattgaggaggagaaatggtgataagcaccgtttagataaagattagaaacctgtactagttcctaaagtgtcttctttatggggatttgatttcaattgattagcggatcatgtatctatctacccatgtaatataattatttttttttgttcatcatgtttactacttgatgcttatctaaaaataatgtttttactttcctgatgctttaaccacagcatcttcttcattgattggaatggattctgcctctagtaatttgcatttgctgtccttcatactgtcaatttaatgtgatggcagtgattattacaagcgctacttttgcaattcatttcttctgacgagtgatttttttttttaaatggtttctagctgagctggaatggaaggtgttgttgtgaggagggtgatcccttcggacaacagttgcctcttcaatgctgttgggtatgatttctcaatcatggtgctatctatatattattgatggttttgcaaatggagcggttgccgattataccttctttgatacaggtatgtcatggagcataacaggaacaaggcttctgagctcagacaggtatctgctttgaaagactaatgtacctgcatatatgtcttccctctcactcttcaaggtttttagaggctctgatgttgtaaaaaatgatatacatccccctcgtatttttgcaaactcgaaccaaagctatcatcatgcttgctagaaacttcgtgttctataatatgtttatagtatttggtatcaaacgtttgtatatgctccaaagtcattttctgccaaaaccagttgtactatcatgtgtggctgcattaattggaatagatggaatgatattgttagcttggcaatgatattgatctatcatatagatgagctactggccttaattcaattcgtgtgataaacttctttgaggaactcttacatggcatgcactgataactatggaattcagttagatccattggcatatctgttactcaagcgttattttgtcaactgtactagtaatgtttgtaatttattttaaaaaactgtatgcgggagtattgatgttcagctgctgtgttgaattcttaccccttcctcaataagtagctatgttactatactttgtttaataccatcttttggtagaagaaaagaataaatttaatagatagtgtattagctcaggtatgataaaggcaccaatacgcatgtgatgatgtcgatttaagctaggcttacaattattgccttactgctgcaaaattcagtatggttgacattgcgtttttctccctcttttcttgaaggttatagcagcagcagttgctagtgatcctgcaaagtacagtgaagtttttcttggaaaaccaaatgaagcgtactgtgcttggattttggattctgaaaagtggggaggtgagcttttgcaccactaatcatgcacagcaacaaggctgaaaaacaacctcaatggaaaccgttcatgctatgttgtttatccatggattttgacatacagtcatgcaccacattttgttgcatcaatgctctaaaatttgtgttaaaacatccctttttcgcaagaggaataatgcaatgtcatgcttttccacatttatgccttagaccatgaaaatagttgagctcatgttctcttggtaagcatctttgctatataagtttcagcctccattagtagtctggtggcactaaaagtttctccaaatgatataagcactttgggttaccagtacaagtgcttctctttctagagttgcaacaattaacactacttgtgatgatttactagtttacctgctgatatttgactttttttcacctctgtttcttcaactgtacaggtgccattgaactttctatcctatcggaatattatgggcgtgaaattgctgcatatgacatccagacaacccgctgtgatctgtatggtcaggttggtggatcttatattcctttacttttgtttatcctaaagtgttaaggcggtgtcttagctttgcatcccttgatacaggagaagaactacactgagcgaactatgctcatctatgatgggctgcattatgatgctttagctgtaagtattcatgataaatttttgacgataaacaaaacacaatgagatgccaactaattttggctgttttttatcaacaaaattcagatgtcaccatttgaaggtgcaccggaagaatttgatcagactatcttccctgtcgaccacaaatggtcgattggcccagtagagggccttgctcttaacttcgtgaaggatgaaaagaggtatctatcatttcaagcttagttctttttttcctataaagtatctacataatttgctgaaatcagtgatgccttgaacagaacatttagtttagcatgtaaccactgttcagaagtgattcaaaatatgcatcccagaaaccaaaaatgaaaagaagaggaagaagaagctttagctcctagtaaattgcatcatcgaacatgatcatatgtaatcgcaagtgcatcatgtgaatggtgttcattcatatgtcttattcaccattggttggacatgccatatgcaggaagaggagctacacagacactgcaaacttcaccttgcgctgtggcgtctgccaaattggtgtgattggtcaaaaggtaagtgatgctcttaaaaacacaaaatgtttttgtttataccaatccgtgatgaccatgaactgatcaaagccttctctcttggtgcacaatacaggaagccgttgaacatgctcaggccactggacatgtcaacttccaagaatacaaatgactgtacaagataaaacctgtgttgtaacttgtaaaacccatgttcatttgttccaattgataattcttctcgggttggatatggtatagaactgtattacaacatttgttacagggtaatttaataatgccagtttggataatccggtgtgatatcgacgttgacttgtcaactatgcttgattgtagtcattaccttgcatatcagcttctgattttgttttcattggttggttcacgctcacccctatacattgaaaatggaagaaaacttacatatagatgaatgtggcttacgttttgctgcctgatttcgaaagtttaaactttttaactcgaaccaagggtttagagtctcaacgattttaaaacatctcgagccggcgtgaaatgtgcatttcaaatggttttgttcgaaatttggctaatttcattcaaaattatccaaaaaaaaaattaacgtcttggtggggctggaaattaaactagccaatcgagattgcagactctgcttccaacatactacctcaaaactactacgaatttgaacagagataaaaacgaagttatttttcctcggatgtctgtgctgatggatgagttgagagttgttgcttcaaatcatcacatgggccaagcccagattctttttatttttcatttttgtttcttgtgggctcctttggttggcatgcatgcagatgctcaggtgtaagcttttaatatggcacatgcacgtacgcagtatagattctgtggagcatactgttttttcttttgtttttcctgtcgaccaggcaggaatctaatctattagctttgctcctggtcaaacttcccattcaaatggtgataaaaaaaacttaaatgagtcgatctaaagcagcatagacacccatacctgaattattttactcccaattaacatgagaccaagatagattattattatagtatttgtacttagtatgcagaaacacaggcaggacatgtatcctagcttacctttcaattaatttcttttgggaaacaagaggaaatagctagagagttggtccaagagcacgtagtatacctgaaactgaaaggcattgccatccaaaggataaaagtcacatgttgaaattaatctgacaacagaattaaataacagtaattaattttttttgcggggaataacagtaattaattaacaaaaaggaaaaggacagcagcaataacactaggaactgtagacaagatcggtctttcatctttgcatgcactagctggagtactactgcctatggtttggccaattgccatgctagggaaaaaaagataagagaaattattaaaagatatgaattaaacagtgatcaagttacatgcataaatggagcccacattgacatagtaatatatacacccagcttcatcttggcccatgcatgcatgcccagccatattactgtacaagttattactagcacagtgatatatgggccccaatatatattgtgaacactgtgttagatgatactctcccatgtgttacccaaagatcaatgttgactggttaattgttttcactagagaaaataaaagctactccttttgataactactactactccttttgttctttcttactgattggatatcgttacagtctccaatgtacgtgtgtttcgtcactattttatttctaactgtgtctaaaatattttaaaaaatgtacttttgttatgaatgtactaatatcgttttcacatataaaatagcaaattatatatatatatatatatatatatatatatatatatatattagtgatttacgatttaaagatatacctgggtcatcttagcaggacgttataattatttatttaaatattaattaattaattaattaattaattgggtgcggcctcctttttcattctctttttgactacatagtcatccagtagatctccctcctttagtcgctgtcaacgtacccttccaatccgaatttgcgatttcctcgtgacacatcgattcgacccgctttattaattttgctttctccttagctttccatgttcaaatgctaaattataacacctggcctttattatcacataattaatcagtgtatcttagcttaattactctgtagactaaaattaactaatgctcatgacatcaatccgaaagcaacacagatatgcgcatatatacaacgttgagatagtgcagcgtgatacgtccatgtataatactcactttatgaatgattaattaacttttggataagtgtgccaagtgtataaacttataaagatgacgtgtacgtatatgtcactattattgctaggtaagctagagctatagttgcaaggttggataattactcattaattacttttttaagaaagtaatagaagtttttattgaactcagtaaattgcatcaagatgatacaactgcaatgacaacactctcaacctttgtataattaagatgtataaaaccaaaacacacattaactagtttaaagaaataaatcacataaagcactaaggaccatcaatcctaaggcttattaataaacaataattgaatgtactagcaatgactttgtgagttcttttttttaattacttagtgaaattgtggtgctcatgaggtcaactagtttaaaatagtgattctacctacggttctcgagaggtcccgtgtaaaatttctcccaataattcagatattagagggtaccaaattttatacgaaaaattctagtaactctcaaggacctaaaatttgacgattaaaatcatttctttgcaaaaaaaatcactttaattatagctaattaagtttatgtatctgcaagactgcaacctggtatatatgtaaactctatgtaaacagctagaaatgtacagtaaaacataaggtgagcaagcgtgcctgcagatgcatcagtacagggcttctctctttagcaacaggcatgaaggcatgcatgcatgcatgaggtctccataattaaaagttagctagccccaaggggaacattgattccatcctaatcatcatcattgccccctcctgggctctctagaccactcttgcacaaagcaaagcaaaatattctcaattttaattaggagtagatgatattatgaacctcctagagagatatatatgtcttggtcttaacctttcatgcatcaaaggatgaccccacatgtggcaatatcatatttgggtgttgtccttatcagatatgcacttgcttggttagcaactcggcccttgtgattatctgctaattaattaacacattaattccctctcagatagggagtacctaaattggattagccataggcttttttcctggtagcattaggatgtgctgtcactttagaatatacatagactatgatccattggatttgtcttatgtatgatatgcataattaaggatgggacagtgatgagaagctaactccaagagagtcccatgcaattaagcatgcactccgtcccaaaataagtacagttttacactatttacgttcaacgtttgaccgttcgtcttatttgaaaattttttatgattaatatttttattgctattagatgataaaacatgaatagtactttatgtgtgactaaatattttcaaatttttcacaaatttttcaaataagacggacggtcaaacgttgggcacggatatccacggctgcacttattttgggacggatgtagtatgtaattctggtgaattgtactgacccagctctgttgctttcatgcatacacagtacaactagctagacctaggcatcattgggttaagtggcattatgtgaagtactgggttggttaggcccaagggacccctacattaatttcctgaacctaaccttagttctgaactggcatttgtgctcaacgaaaaattggtgttattgtgttactccctccctccatcccataaaaaaaagaatctagaaccgtatgtgacatattttattactatgaatctcgatatacattatgtccagattcgtagtattagaatatgtcacatctggtgttaggttggttttttatgggacggagggagtatgctaccggaatttgaattgctcaaatacatttattttgctatcaatggtcctactgcccttgtgtgcataatttgcaatcatgaagaaagcagagggagaccctatctatctgctgaccagatctgaaggagccacctagaagtgaacctccaccatgctgtcttcatctgcattgccaggtgaatctgcattttttttctctctgatgagttgcaatttgttactgtcactctatgtagaatctactccagaagtagaacaaatcaaaggtgaaaattttcaagagtatatgttagttccaatctgcacatgactgcaggctgaacatatgtcacttgtatttactgcaagaaggatacttgcaataagtaacagaatatacagacttgaggggcaaagattgtatctctttctgaatttggtcatacatgtaatgcatacaagcttttaagatgatggccctactcaataaaaccaactaaccctagagtggctatttctgaacattgctacataattttatactgctggtacctaacctcacaatcttcctttgttgattgacagtggggaagctaagctttagggcctttgccctaacttgaggaagaataaggccatcttaggaagcatcattggatgcctttcttgaccacttttgacactatgctactactactacctctcgatgaaattgtcttgtcatgctttgccaccacatgcatttctttctttctttctttctttctttctttctcatgtccaagattattcattttagttttttctaagcacagaacagagagggcccaatatatggacccaccagctcattgagtggactaggagcaatgcgggtgaatttatctccatcaagtctattcttgttgtcagttgctatgtacagtactacttatgtgttctacccttgatgtagtacatttttttctgaaagctgcatgccaaagttcagcaataattatattatgcattatgtactcaaaatcacttcttttcatctctctctctccaactgatgtctctgtaagattgttactgtatattgaaaaaaaaaagaaaacactgtactccctccgtctcaaattgtacacggatctgaacgtagctataaaagttggtttattttaaaacggatgaagtatctaatatgtgaaaaaagaaaatttcaaatatgtataggagatattagtatatgtgatgcaagtctattgtcagtaatgtatatgaattttagtccctattgttgacagttgccaacctcgtctgtcagcgagctctgcaagagaacaagaagcgtcgatcaagctgaggcatgattgacgcgtacgtgcatcgtggcaacagtcagtgcaacagttctctcgattgatcaggcagcgagactgacagctcagacagagtgattgtccacgtggcatctcctgagcctctccatcccagtgtaaaagcaaacagttcagcgtcctgctgagatgatgctgatcagcagggcaaaattttttgcaacttgttttcagagatagccaggcttttgcaacctctgcaggagaagagtgtcacactgtgcctgatgatacttcactgggagttagcacagtgtaaaaaaatttgaaaaaggcagagtttttaatctggatatgagtactgctatatactactgctagtagtataatattgcagctaatcattcctatagattcctaggagaatcagaggacttagacaggcaaacagagctgatcactgatcaggtgatgcatttttgcagcagtgtgccatgatagatatgaaagctggagtagctgcaaatgtgtgagaaaatgtgagagtgtcacgcagtggtttgtaccaagtgtaggcgagccgttggatcgagaatcgacggctgcgattgatcttggcacggcgtactgttgatcattcaatactaggagtggaactctgtctggtactacactcccaaagaatggctgcaatggatctgcatctcaactactttgagtgcctgctaagtttactagtgccccaatcagattaccttaacgaaggtagtgaattatacactgaaaaaggctccatttgtaacgtggaatttgttttcatttcttaccgttttttgtgaaaattaaaccgattcttgggaaactctctgcaggcttaaaaaggctccatttcttacccttttttgtgaaaattaaaccgatctcatccatcttacagtatgcagtgaattgcacacataaaagactctatttgtaatgtggataagaattatatctgtacgttttacggaaattaaaccgattcttgtgaaaatcctatgaatttctgcaggcatttgaatgtttaaattccatggatctcatcctccttacacaaggcattattgatgcccaagtactgtggaagtggcactggattgttttgcagtctatgagcacagtggctcttctgggtgattagttgaaggcaatttatttccctggatataattggtgacaattgtacagccccactacggctaccaagtcacatcaagcacaatcatactgttcattgacacaacaaagggaaaggagaggagaccacacacagtaccttatgctgtaatgagagttatggcacaggatggtacaatttggacaagctcatcctactgctactccattgcaattcatcaattggatggaattgtccttgcatgacctctccaatggctggctacctagggctcttatggggaacttgagatttcgagaagcagctgaggagtgacgagaagatagctattgagaatttaaaaaagttatgttttctagtttgtcttctagtttatttcctagattatatagcttctaattcttagaatttcggtgtaaagctaaacggtttatgagagttgaaaattctagaagaagctgcagctgcgagaagctttcccaaacaggacctttgtatactttctagcctactagtagtagtgtctggtatacactttcatacttgcatgaggacaaaaacctgtaaactgatcaactttaactgctgctgtaaattgatatgtacaaggatctagtagtaattattgttagtcaggtactaacacttggtggttgggaaaattcttatctgttgttgtacaagaagcatatggataaaacaacagagctgtactgacatgatacaatcaaccttagtctcaataaaaagtttaacagtaataagcagttcaattccctgtagggatctagtagaaaaagaaagactctcatctcatacaattgcctaggaggcttcaattgtttgaaacagacttactctgattaatttatgattgctagaatgcataattcacagtttcacacttctgttaggggctgctcattttgattttggcatgtatcccaacacttcctttttaaaaaaaaaaataaaagtgaggttttggcatgtacttttaccacaaacaagatgtaactgttcctctaaaaaatttaaaaagagatggaagatgtaattgtttgaaacatctatggggctatggcacctactgttttgaggtgctgccctcacctacttaggagaaagagtacccaccctctgccaatcccaaagagctctatctcctagagcatccccacactacaccttgcaaatgaattggccctgtctcaccattgccaatgcaaggaaacaaaaagaaaagattgttgaatttgactcttggatatagtttcccacaaagagcttagccctttctccaaagtggtcatagaaagagataaagactcgagagagggtgtgagagggaccatttcttaggtgcccccagcagttgcaaaaaatggtcctaactccagactgcatccctgcatgagaagttgagcacatttcatgagcaaaatttttttactgtacaaggtcccaaaccaatccttttctttgcttccttccctaagtagaaatggcaagagtgcaggtatccagaaaaccaggatgtaatgttccaaattcttggttggtagtatctctatatatctccatgcatcaccatttgcagagtccagcagctgttcagatgctgaattttcagcactcagatttggcaacaggagttgtgtagtatcacattttttttcctttatgccctgctgaccctcaatcctgaaaagtaaaatgtgaatcaaattatatctattagggcttcttcagaacgtaggaactttacaggattttcattggaaacatttcaattcctccaaatcgattggcccttaatatttttacattctccaaatgcatttgcatatgtgcttattcctgccaactttgatgtatgcacccagaattgtggccatgaagttaattgaaaattaaatatataacatcgaatcactcttttctgaaaccaagtgcctgctctgcttattgcacatagtaggtttttctttttgtgtcagtccatacaaatgaaaaggacttagatatttgcaataacatattatttgtcacaatcagcacatgcttcttgagcttgcccaaagtcctggtcctgcacattgctgtacaactgtgtctgcagtagcatgatagtagtaccatcagaaaagaaaatatgaaccaaaactgcttgcagcacattcagagatagccctgtcagactgtcaccatccgaggactaattaagatggccattctgccataattagtgaccaaaccagaccattgctccccttaatcagtaccttgattgatctgttactactagtagtagtagtactaatgaagctttgcattaaaacaactgtagaatatgcatgaagtgcaacagtgcatgacctactacccagttttcaggacaagacatgaagcacttggctgtgcgcaatttgttaattttcttgtgcaaaatgccttaatctctctcaaaggagatggtaaagcgaccggcatgtgaccctgccaagaaatgtcaagattagtctcggttagcctccggatcatgagggacctagctttcactgatgacttgtccaagaattttatagtaattaagcgtgatttccatgtggttatcatgtagcggtctctgaacgttagacgattgcatttttgttattccctccgtttcatttttttttcataagctaaatgtttgtatctttataacttaaaaattcatacaatttagatttatatttgtagatttatcttgagaaatacttataagacataattggcatgttgttaaaccatacgagttaaaatatattgattatcaaagataaaaaaaaagtttggcttagaataaatatagaaagacaaccaaacaagtattttaaaacagagagtatataaattagaatttataaaaatgttatacttcgatatactccctctagtaaaaacaatatttgacatcgatgttaaataaatttgactggagggagtaatgaactcggtactttttctacacttgtgttctcaaagttcaaaattttcttttgagataaaaaagtttatgaaattcagcaaagtctatcttatccatccaagagagagtatgcgtgcatatatatactcatgtattttagggtatggacccaagatggcttttgagggcaaatggagatgttttgtgctgcaaggatagggcacagtgtgggggactaggcgtgtcggtcgagtcactgtccaaaccagaatcccatttaggccgagtttagtttcaatttttttcttcaaacttccaacttttccatcacatcaaaacttgcttacacacataaacttttaacttttccgtcacctcgttccaatttcaaccaaacttttaattttggcatgaactaaacacacccttatccaaacccaaagctccttctccttctccatctcctcctctttctctagccatatagatcatggatgttcttcacacgttgccaaagatgcttcttgatgttgccattcatatgcatcgatcgatcgatgcgatcgatcgccatgtgatgcgtcgatcgaaaatggctggagactgtgcccaaagggcaaacgctgttatcggctttctgacgttcggtgtctctgcgctttgtttgttccattctgcaccctttccgacgataaaagaggattaagtttattccccggaaagaaaggaattggatctgatcaattcatctgtagatgttgtgggttatcaactattttgatttttaggaggagtctaataattcacatgattattttatacgagtatatgtcgcgtgcacaatctatatatcttatatagttggaaccaaaagtctcgacatgcactgagtcacatcgccctagaaatcctaatcgttggatcatccgttggagggcgagaatcctaaccgatatgaaactgaagagttaaaggcatttattctattatatttctcatgcatttcatcggtataattttaatatattcatttaacttaaattttttacgtttaaactattgatatcagactatttatctccccaactatgaagagttcaagttcattttccctcttctttttccttggcttgtgtaattgagttgtactattcaccaactagcttaacaaatgtttagagtcgaagagacaacatcaaccttttttatgtaagccggcgacttcattaaccgggaacaaatcgcagagacaatataaacttgtgtgtactattaccattaatcttttcttaatcggctcaaaatccagggttagaacttagaaaggtgtcggcatggaggatatatacaattaagcggccaattaattacgagcatatgcgtcgtccttgtatcatgggatgaccagtacttgctttttttctgtgtgaacatgcatgcattagcagcaatagctgctgcagaaaaaaattcagatatgtgtttgacgcagagcctactacgaagtactaaaactttcgtggtccagctgctgatgatgaacagttttcagattcgcatctttcagtacaaatcatctgtattttcctgaaaaaaggatgtgatcgatctaatccaccttttgaatttcattgctggaattccatcgattcaattccattaattcatggctgtttcttcacatgagagagagaatccgacatgtacgtactatacgtactcttgcccaactgtacggtattttcagtatctagctacacgtatcgtacgtatttgtgatagggatagggatttttttattttctttattttttttattttatttttggtgagaggatgggggtggcttttgacagctacggctgaaaattctggactagtttttgacagctacgttttcttaaattccacccatttttcgcgaaaaattttccacgcgatttggacgtcattaggttaaaatcaatagacagtatacttaagctgttcaaaacaaaaccaaacaatacatacagagtataaacatacaaatccagtttgtatagcaccaccacatatgatgcacatgttggtttgaccacacaatttactccgcaaaccaaccaattaattcaattaattaaacaaggtgtaataagaaggaaacaaccaaattattaaatatagttgaggatgaataaaacataagtcaaaaaggcaggatcatggagggggtgggatctctcaccgagaacagaagcgatcccttttcatcgcaacacgtttggattcaatggtccatacccatgacaccgctctctctgtctttgcttggtttatccatccatgaacagcagcagcaaaacgatgtcaaacccagcagtggcccaaggaaagaaaaggcggtgtgtgtgtgcgctgcaaagtgatcacacctttctctccttgcatcttttcctcattttcagtatcttattcttggccgtaattatgatgtactacttaaggagtatacccaagtactagtagtagagtactcattgtcttaagataaatcattcagtacgaaatactcctataaatctaaatataaattatgtgttagaaaagataaatttatttttgaacaacgagagttgaacaaactatctccatatcataatatatgagatacttgtatatggtacaataaatctggacatatcttctatccagatttgttgtagtttatattatactatttctgtcctaaaatatacttccttcattctaaaatataagcatttttagattttgatatagtcttcaagatactattttatccaaaaatataaaagcaagatgttttaaataaaaagagtttcatattataatagtttgtttaatactaataaatctactagtaacatcaatttacacgatagatcttgttttttttctattaatagttaaagttaaaaatatttgatttaacattacgttaaaatgcttatattttaggacggattaacaattttttgagtgcatggatatactccataccattcacttaaagatcgtttatattttgggagatggatcaagtacttttgcagtaaactagtactagatgcacttgcagtaaaaaattctgtaaaaagagttttttttttactgcggggttagaactggaagtagaagcatggtgcagggaggagaaaaggttgtgtttttaaagtgcatagagaaagggtgaaccgaggagaagagagagaaagcgagagagagagaggagctcagctcagctcacctccactcgtggggttaaaaccccgagaactgcacagcagcagcagcacacggcgcagcagcggcaaaggcggcagcagcagcagcagcaagaaccgagcaaagtcgcaagaagcgagcacacacactcctctctctctctccctctctagctactgttgttcttggagttgtagaggaggaggaggtggtggtggaggtggtggagatagggggaggatgctgatgctcctagtcctatcctagttcgtcgtcaactccggcggcggatctgcggtggagcggcggctggattgtcgagcggtgagggtgacacgcatctccggagctcgccgcaggcgggagggatctgaggcgcgtttcttaatttgccttctctttgagctagctgcaaaggcggcggcgtgcggcggcggcggcgtcttggcgcgcgcattctatccggcgagtcgacgacgacgacgaccttcgcgccggtgtagcggcgcccgtgatgtgaaggaattcgagctcgctcccttgggatcgaaaaggttgcgggttggagaggcaagaaggtttggccggtttggggaaggagagaaagcgatggtggtggtggtggtggtggtggctgggttgcttgctccatgacacgacagcgcgtttgggaacgcctcgtgatctcggtgcagaaaggattccttctctgctccatttcttgcactctccactttgcattctagatcggttgggggaagaagaagaagagaagaagaagaatgaagctctcgccgtcggccggcggcgtctccgaccagccgccgtcgccgccggaaggtatagagaatagtactagctactctagcatcttctttctattgggcattgagttgaccagttgcatctcttttgttattattattttttcttttctttttgctcattaatgctcttctcatccattgggtagtttatgttcttaggacaagttagttaggttgttggcttggaagtctttaaatttcgtttggtaattatgtgctccaaatcaattcaatgatgcagcctgtcgatttcttcatcttttgggtgatttgtgctttgaataaccgagttactcctgttacagtaatgatacatacacatgatgcatttttttttcattagactgcttagttatacttgtctacaagcaaattagtgtgatttttatttatgcagtaacttttttccctgtaaaagtcatctgcttctggaaacatgcaaacaattcgtattcttaattcttgagaactctatccccttccccttcatttttttttgaaaaatctttgattttaaacatctttgttagccttaaaattatcttcttgaaatacgttttgaactaggatttgattatgggatggttcaagaattactgctgacaactaaaatttatgttgctgtgtgttcttctgaaatgattttcccctctttcagttgcagaggagcagaagtgcctaaattctgagttgtggcatgcatgcgccggccctctcgtttcgctgcctgcggtcggtagtcgggtggtttattttcctcaaggccacagtgagcaggtagtcttcttcatcttagtacagattttatcctcataagtactagattaacctgctgcagtacttgaagtatcagcaaaattagtaccgtaaattttacgttttttcttatattgcaacatctcattgtcagatcttaaattgcaaaggccaaagatttgtttgagatgttaatgagcttatgtacatttcgtacgtaggtagctgcatcaacaaataaggaaatggagtctcagatccccaactatcctaacctgccgccgcagcttatatgccagctacataatgtgaccatgcacgtaagtctggagcaacacaagacatcttattgaaaactatgtaatactgttgttacttttgtgtctcatcaactttttctgtgtttcttcctttaggccgatgcagagacggatgaagtctatgcgcaaatgacgctgcagccactcagcccggtaaaacagaattttctaccttctaccctatatttgtgtactcttgtttgtatctaagaagcttacactttctccttattttttgttttgttttgtttgcagcaagagctcaaggatccattcctacccgccgagctaggcactgccagcaagcagccaacaaattatttctgcaaaacgttaactgctagtgacacaagtacacatggtggattctctgttccccgtcgagcagcagagaaagtatttcctccgctggtatgtgttcttggttggctattgtatgtggcatcctttgaacagattatctgtacttattcagagaagacaccaagttattagtgtttcttaagggttcctttgatgattctgtaggatttcactcagcagcctccagctcaagagttgatggcgaaagacctccatggaaatgaatggaaattccgtcatatctttcgtggttagctattttccgtttacatccattccttcttaatattgttattttcctcataatgcttgctgccttgttttcacgtacaacttatgtgagagtcaaatatctatcagtgacattctattttcaaataagaatcttgaacaagtatgataaacatgtaaaattaaacttgtgcaggccaaccgaagcggcatcttctgactacgggttggagcgtctttgtaagtgcaaagagactggttgctggagactctgtcctttttatctggtatgttcattctttgaaattctcaaaagtcactaaatttctccaccttaaccttgtcattcccagcagagattttttatcctgtcgtatgatgtatgtctctggttgatcaggaatgacagtaatcagctgcttctgggaattcgtcgggcaaataggccacaaacggtcatgccatcatcagtattgtctagtgacagcatgcatattggtctgcttgctgcagctgctcacgccgcatcaacaaatagccggtttactattttctataatccaaggtaaaccatattttgcacatatctgatcatttcgtacaagtactcaattcgcattcattttgcagagcaagcccttcggagtttgttataccactggctaaatatgtaaaggctgtctaccatacccgcatatcggtgggcatgcgtttccggatgctttttgaaacagaagaatccagtgttaggaggtatgccaaatatttgtttgttatatatcatttaattcattctgtgagcatcacgtaatgctatttccttttctctacgtgtttatgcattgtctgtttatacctttatggttttatcttctgttgtgatgtgtagagcttttgcagtctctacctaatattaagtggcctaaattgcacaattgctcttatttgcagatacatggggacaataacaggaataagtgatcttgatcctgttcgttggatgaactcacactggcgctctgtcaaggtagatcttgaaacatctgtttgtttatagaccactcatatgcttttattacctcatttttagtcttatcatattttcagatagtgtgctttagtcattttctaccttcactatgagcttgcttcaaaattaagcatgtgaacaaggttttctttgaatcatgcaggttggatgggatgagtcgactgctggagagagacagccaagggtgtctctttgggagatcgagcctctgacaactttcccgatgtatccatctccttttcctctcagactaaagcgtccatggccaacaggcttaccttctttatatggtacgagtgacattagcatcttagtcagccctttaaactatagcagtgcacaatgatcaatgatgtctcgtatgtattattagtgcattgctctgatgttatgataatcatattcacctctgatggttttggcaggcggaaaggaggatgacttggcttcttctcttatgtggcttcgagatagtcaaaacacaggtttccaatctctgaattttggaggacttggtatgagtccgtggatgcagccaaggctggatagttccctacttggtctgcaacctgacatgtaccaaacgatagcggcggcggcggctttacagaacaccactaagcaagtatcacctgccatgctgcagttccagcagccgcaaaacattgtcggtagatcttctcttctatccagtcagattctgcagcaagcacagcctcaatttcagcagatgtaccaccaaaacatcaatggcaactcaatccaaggccatagtcagcctgagtacctccagcaaccgcttcaacattgccaatcatttaacgaacagaagcctcagttgcagccgcagcaacagcagcaagaatcacaccagcagcaacctcagcatcaacaaatgcaacaacagaaacacttgtccaactttcagactgtaccaaatgcattgtcggttttttcacagctttcctccacccctcagtctacaccctccacattgcagacagtttcaccattctcacagcaacataatttccctgacacaaatatcagttgtctctctccatccaatgtctcatccatgcacgatacactgagatcattcccttcagaagctgcttcagacctcccaggtgtgccaagaatcacccctgtacctgtctctgacccatggtcatctaagcgagttgcagtggaatctacgatcacttctcgcccacatgacatttcatcacagatagagaacttcgacttgacaccttctagtattcctcaaaactccacgttagcaccactgcctggaagggaatgcctggtggatcaagatgggagctctgatcctcaaaatcacttcttgtttggtgtaaatatagactcacagtcacttttgatgcaagatggcattccaagccttcacaatgaaaacagttcaagcacaattccatattccacatccaacttccttagcccttctcaagatgattatccattgagtcaaacactaactactccgggctgcttagatgaatcaggatatgttccatgttcagataatgctgatcaagtgaagcgaccgcatgcaacctttgtgaaggtgagtgaatggcttgcatgcttgatgcaccatcagttgcaaagttgcatgtttttttttcctttttcctcaattcactttgaattgacaaacttgtgtcctataggtttacaaatctggaaccgttggaaggttgctcgacatcactagatttagcagttatcatgaacttcgtagtgaggtagggcgcctttttggccttgagggccagttggaagaccctttgagatcaggctggcagcttgtatttgttgaccgagaggacgacgttcttctagttggcgatgatccgtggcagtaagttttaacaatcatcacgagttccttagcatctttctttactgtttatgccatcttcttacatccgtgaggttcggaatctgcagggaatttgtgaacagtgtgtcttgcataaagatactttcgccgcaggaggttcagcagatgggcaagccgggcattgaactcttctcgacttctgcaaggagacttggcaacagctgtgacaactacatgagcaggcaggaatcaagaagcctaagcactggaatcgcgtcggtgggctcagttgagttctgagaaatagggagctcatagcacccggcgttaggcgtccagttctgtacgtctctgtagctcttagttctgtgacctggaacccaagcacataggtcaagtgtagctctaagttatgcgctgtctggtaattatgtcatattacattgacttttagtggtacctattacattttggtatacatgccgacactttgtttcctggaatactgatcatgttaacttagggcatctaattattaggttcatgttgagtagtgctgtagtgccgcaggcgctagctttggccatattctgtatattgatgatgttttcctcctgcaatgtactgttaatgacagcaagtaaggttttccatgcaactgtgaaaattcagttcaagaactattgagcttatatatgtactactaccaaatcagtagtaagcagctttgttctagaagtgttccaaaattactgacatgttgattagcattgctgttttcagtaaaaaaaagtagtttttatgtgatcctggaaagctcatagatagatccatgagggaattcacctgaacctttatgcttacataatttggcaccagttcttggggacaatgacaggcaaagaaatggaccagccatccatgtgcctcttcttcaaggtccccatctgactgaagaacccttgacaagtgcacacccaattgaaccaatggttggaaaaaagatagcctccctttcttgaaggtcagcggtggatgatgaggtgaatgtgatgccttctctccccatcacatatccatttcttcagggtcctaatgcctactggtaatgcctatccctgttctgatcccccttcgtcgaccttccggtcgcgccaacgtgttagaatttggtttgatttggttttggttttggtttggtttttggtggttgtggattgtgacaaatttaaagtggagggggggaatgtggagtgcaatgacatacaccaccaccatccactcttttcaaagatatggggcatcttttctgaacccaatcaatttcttttctgattcctccatctctttcagatctttggctgggaccctaatttggatcccagatcatatcatttcctaatcttgactgacttttcacaacggaaaaaaaaaagaagaggaaacctggcaatgaaaatggaaggaggtggagaattgccacacatttttcatgcttgtttttttcttcacccctgatgtctatgaacaattagcaatgtgccaaaactgtcaacttctgaactttctccctagcccactaggctaatagtatgtaggtagcatcatcatgtgcaagagaattatctcctgctgttgcattggtttaaggaggcagattctcttacctgctttctggctgtggatattgtgtggttgaatagtgttgtctgcttcagaagcatgtggtagtgtgtaagttggataagcttgtctgcttgtaatggttctgtctgcttgagatgcataagcttgctgctgactctgtcagcaagaatgtttgaagcactggtggtaccatattgatgttgccttttactgtcaattttaagcttttgaagtagggccttgcttcagacctcaattttagaaagaaagtatgtagccatatttttaagtagtaaatctaaaacaaaatcagttaatttatgcccccctttgatttatagaaaaaaaaaacatcggaaacaaattcttcaaggacttttgaaacaaatgattgaatcatatccttttctttgaaatttctactgaatgaataatcctatagatattttggaggaaagttagaagtgctccaaacccttggaagatttacttttgagttcctctcttatccgctttctgtgttttcttatggtctattcaaaagattatttatgtattttttctatgttttacaatccaattttttttcaatcttgtggagccttaggttgagaaaatttgtagcaacaccaaaaataccaaaaaaaaaactattgctttgtacaacttcctggcatgtatcatgtgagattgtgagggcatgaaccggaacaattgaaatttaataatatatattaaaaaaatatatttttaggagttgaaaacttctggtgaatttgattcataatccagttatctaattgaaaaaaaaaacatttttttgcccaatgatcatgtcaaaccggtgaaaagaacattttttttcttctattttgcacaaacttggactaactgcaaacctgaattctacattgcaacatcgatttcatagcctagtattgctcttcttccctccccgtcgatctgcttggacaaggagaaaattaagaatatactgctctatttgataaatttcgataaaataccactctggatcctcgatgtccagctcggaaggcggttaggggttgagagatcttggatgagttacttcacctgagcggaggaaggaaggatcaccggagttcgccgttccacggaggcgacgccacagcaagacggctgccgccggtgactaccacgacgacatgaccctgggagccagccacgcctcgtcaggtttccaactggttttgaccagttgaatgaacctttacatgcctgttatggcattgggtatcaggatgtagtatatgttacaaacttacgaagttgtaatgaaaatgatcatgatgtgactgtaaattcacaaacatcttcaccatgtctcggatttcgtcgaagttggatatacagttcagggaacctgactgcagaaagaaaattcagagaattgtagcatctccatctcacagtttgcagcaaagtaaaatcgacaacgatgagctatatacagtttgttcatggttgtgatacaaaggtcggtgtgtagtatttgctttcgcaatttatacatttcataaacacacatatcacactggactactaaactataaccgggagtaaatggagactgctggacctttttggttcagagttgagagacttgagagccccctttttctgaataataactttgtttcacgatcaacttaggtggcaaccggccatggcattcttggaattgcagatttgcggttttaccagtggcgcctttattccattcattcattaacacttttgattttgaatctgcagaattcagcaactacacgaaggtgagtattcatgatgaaaaaatatgagctgctatctttcactctacttgaaagttcaaacaagacttactttatcatcaccatgatacctgcaaaaccacagatggatcatcttcagccatgttctgcagactgttgatcgcttccgctgccttgctgcctagcattacttgcagtgttctcgtttgaagcattgtttccagattgaccatgtctgtgatttctacgttgagttaaccgttgattccgcaggagtctccacctcaggtattctattagcattgcatttagactaatagcgatgccgaaaccagtgaacgatgcaagtaggattgcaaggactgcccccatttttaactgcatgtttagtaattgtaataagcaatgtgctgaagatattatctagaaaacttattgagcttacgtcaaaaaaaaaaaacttattgagggcaaaaaaaaaaaaacttattgagggcaaaagctccataccaagttgtagaaaatatgagcaaataggattaggaaagcaaactggaacgtagcgaaagcccataggtaattatcggttgctgtttcacagagataaaaaaaaaaggttaaatgtggaattgcggtagctgttcagcagaaatgctggaacatgataatctgagtttatttacaccaaatgatcaagtaactacataacatctaatatttggttttaaaatgagatcatggaaagagcggtaaggagttatgttttacattctgttgaaaagctgaaatcatattatataataattgttttccctggtaaagttgttacacaatcaagatatatatatatatatctaactatgagggtagggtggtcaataaataaatctgaatttggaaaacagtgagcttaggtaccaaaaggctttttggttccctacacaatgtactgaactcatgattttgcaattgcgtagagccagagaaaagcaagtagtatttcattacccattgtggatgcgaggatggaagaaaatatgcccaggagacaggagaaaggcaaagaaatagctagtgcacgtgacttcatatcagcaacctgttaaaagttccaacaagtgggacagtggttgggttaatttgacatatacacacaaaattcacataatggaaagctaaaagaagtgtagcacaaagtcacaaaccaagagttgctccaagaaacagaagtacgcaagcgtgctgaccatgactagaactggagtctccttccaaaatctgtcagaaaaggagaatttagtaacaagaagacaaatacattaatgtattaatgatatttctcatagtatagacagaaaaaagaacaaaacaattgtcattcataaaacgtgaagaaaacaacactcatccagtgtgcacattttataagggtcaaaatatcttcacactaaaaaagtgtgttttgaaatacctgtgtggatgtgctgctctttgctgaacaccattccgcggttgtctgttaacagttcgaatctgtattctcaataaagtcacaggtagattctgaacttcctgcctgcaaacatcgcatgtcttgtttcccttgatgctaaaccattttattgcacactcctggtgtgcaagagcaagttctcccttgcagctgcactccaatttaagtgtttcacctccttcattgagttcaactaggcaaattctgcagacagcatcttcttcaggaatgtcttcacctccatcttcaggagctaccaaggatgaacgacacaaaattcagtgtttctttcctgcagctttgctatttgaagagaacattttggttcacgcgaactttgattgcgctacaaaacgttttgtgcctaatgtactgtacactgacatgcaaaagagtaaaaatccaaggttagtaccatctactgcttcttcaatgccatcatttgatgcaacagtttcaacaggaacaggtcgtggggttgtgggaatcacacgtataaggcctgatgaagccgtcctcctcagatccttactatcatgatttcctggtgctgagagtgagcgcctaatttgtgtttcaacctcattcttctgcaaccattgtgaaccacattaatacgagatgatcctcggtgaactgggcgcatctcatactttaaggtgtaaatgcaccagtttggttgtttgataatagtccatttaatttccactgtatacatgtactagaaaaaaatgcccgtacgctgcaacgggtgaagattattataatcttattattgttatatggtttagctaggataaaattcactgtggaaattcgcttggatatatatatttttttagaaaatcatgagctgcaattaggagtctgatttttatctcaagttagtatgcgagttttctcaaagagatttcttatacgactcattttgtttttctaaaagcaaacgaacttaaaatccgattcataaacggatctgtattaccaaaagcgagcgaacataaaaccgactcaaatacggatgacataccaaaataccggcaaaaacatcttcaatttttagtagagattatgtcatattacgtcaagtattattaaatcccacaacccttgccatggaattgtgttataccaaaatagaccagcatgcaaacaatgcagtcctagttaaatacttacaactgtacttggcaggttgtctgcatgaccttcatgagaagaaggtcctgaagctgcaacaggagtaactggaagagagtgggttcgcttcgctgataaggagttgatgacctttgtgaaagaaaatgatcttgatgtagttgccttcacctgctgtcctgatgatgatggtgtgtcaggaattagaagaattgtctggtcaccatcctgtaatgaactctttgctttgaagctcctttgtggaatgatgcccctgatggatgattttgttctagttgaattcggccttggtggtaaaccacttcttgcagaatttgggctgggtgatattttgattctagttgacgttggcagagtgtcatcaaatgccctgtttggtatttgtaatgaaaggtttggccgtcgcgaattctgacaagatacaccatcacttttagcatcttctccctagtaacaattcaatcgaacaacaatgtcaatcacttacattaaataattatatgattggtttgaagcaaattaaaaagaaagagtggcaatgtaacaaaagacaaggaaacgccaagaatcaaccatgtactaggctactagccattgcctattgcatcatatattcatagtactaaatactaacacgaggaatagatactcatttggcatcaccacatcactgctgtttgtttcttcactcttctactccctcttgtcctgtccagattcgtagtcctaggaagtgtcacatccctccaaaatcccttatattatgagacggagggattatcaagcatgtgttcacattcagacatggaacaagaaactaagagggcctttactaaatttctgcatgaactgcagtggtgctcctaccatggtgcaaagaagagatctttttagataatggaagcttttatttcgagataggtgcaagtaagagtaggacaaacgcctgtctggatagtttatcagaaatcttcaagtatgaacagagacgagtgcactctccaagactaatagtgagtgcgtatactgcctttcttaattctcaaataggagtagtttggtttattctgtgtgactgacagtcacagcattcagcactaggtcctaatttgagcctttctgggttaatctttgaggacagaaaaaaactaatattgaattcagtagctaatatggccatgcaaacgtctttacaaattacaatacgctttgttatgaaggtttcagtgaaacagtttgatcagaatatcagtgacagttattcagtcaagcaactggaattaaacagcagtatcatgttaacaacgcctgctcaaaccgctaaagcaaagcaaaatcgaaagagtaaaacactaaaagagtaaataaactatgtatgtctagctcgcatgtgtatggcaacaacaaacaacagatggcgaagaatccacaagattccccaccaaaacagccaaaaacgacaacccaattccaaaacagaacacccccagagatccaaatctttctaacgaaatacagacactatactagctcccatgacctattggaaacatccaagcctgaagctgacaaagaatcccacacagcaagctaaagaagaacaaaaaaatatcaagaattggatccccggggtgcagaatctcaccgcgcgattgctggactccgccgccgccgccgccgccgccgcaccaccggggctatccatccgcggctcaactagctcggcgacggcgagagcgagagacagagagagagagtaggtggcgtcgctgctgtgtggagtcgaagtcaagggaggtggactcgcgacggggggcggtgcccagttgaggggctcgaggatgaatgatgacgtccgcttttgcagtttgctccaccacttttctggtatttttttcttgacctcgtactctcaacactttgtccttgctaatttttactgcctgcctccgtctcatactatactccctcacaatatgtaacaacctaagatggatcgactacgaatctgaacatagggtctaatttcatcatgggttgctacatatctggatggaaggagtagcaatcttgggttatacatgactcttgagtatgtgactcaacctagtattatgaatctgagcaagcttcatgtctaaatccgtacttcctccgtttcatattataagactttttagcattgctcatatctattgtattattaaaggaatagaaaaagaagcctccatgttcgctctcatggtctagaaattctcacattaatcggagaaaagaaaagacagagtccatatagaaatacaatttagaaatagttgaaattcggaattaaaaataagaaatattagaataggagactagagtccatatagaaatgcaattaggaaataactgaaatccggaattaaaaataaggaatattagaagtagagtatagagtccatatagaaatacaattagcaaataactgaaattcggaattaaaaataaggaatattagaagtagagtatggagtccatataaaaatacaattaggaaataatagaaatttgaaatttaaaataaggaatattagaggtagagtatagagtatatatagaaatacaattaagaaaaaaaagaaattcggaattaaaaaaataaggaatattagaagtagagtatagagtccatataggaatttataactaactaaaatttagaataaacataataaatttattaaagtcaatataggaatacaatttagaagtaactgaaattcgaaattaaaaattaaaaaatattaaaagatgagtttagagtccacatataaatacaattagaaataataaaaattcagaaataaaaataaataatagaagagcatatagtctatataaaaatacaatttacaaaaaatttagaattagaaaaaaagaaatattaaaagatgagtctagagtccatatagaaatatatataatttacaaataactaaaaattgatattaaaaataattaataactaacacgtatataaaatacaatatgaatattacacattagtagttttgtaaagttattgcgaaatttaaaattatgttgtcattttaatatatttgaataatataatgagaaaacatatatgctattatatgagagaaaatataatgatgctagccgcgcaatttgcgcgggccaccatgctagttcatatatatgttaatgaatctagacatatatgtgtgtctagattcattaacatctatataaatgtaggcaatgctggaaagtcttataacctgaaacggagatagtagaatagattgagtctcatctgataataggctgctatattttggatggagggagtaagcaaaatatcatatttaaacgtgatgaagtgaggattaaataatggcatgtaaaacgagaaagtaactaatgtatgatttaattaagttaataactataaattccaaaaatagacttatttgatattttagagtaacttttacataaaaaaattccgttcgtatcatttagtcctttctttagatcgaaacaaggctatgatcgctgaaaatttgttactactctctccattttaaagttataagacattatgactttggtcaaagtcaaactacttcaagtttgactaagcctatagacaaatatagtaatatttataatatcaaattagtttcattaaatcaataattgaatatattttcataataaatttgtcttgggttaaaaatgtttttatttttttcttcaaacttagtcaaacttaaagtagtttaactttgactaaaatcaaaatgtcttatgacctaatacggatggagtactagtgtacactcctactccctccgtctcataaaaaaactaactcagtactagatgtgacacatcctaatactatgaatccgaacatatatctatccagattcatcgtattagaatgtgtcacatccagtcctatattaaattttttttttggacggagagagtaagcagcaagctgccccgacgagctttgaatctttttcatttttctgaccaatttaacagacagatgcatcggaacatctggtatttgtctaaaatgcttgttatcaaaacagagaaaaacataattggtgtaacagaaacatgagcaaatatgcaagcaaacttaatggaataggggcatagcttcctttgaaaaaagaaaaaaaaacaaaatcacacacactaaaaagaagaggtaagattataattacgactcaaagctagggtataaacataacggtcacttgtttgaatggtacgaggaacttaaatataaatttgtcccattggaatattcaatattggatcatttgcaagctggctgatcggctaatgaaaatcagaaataatcaattgaagattatcacaaggtgtttactgaaaattgcagcttgttccaaaatccaaatgtccaccagctgcagagcgagcacactgaactggaagtgcaggcttattgtgcagtaaccaaaagctgtctcatgagtggaggattagtccccgagcactctgagattagcatttttagttggccaaatcattagccgttcgttcccgcgggccccacccgtcggtgactgcacagtgctggctcaccgtagaccgtgtccaaatggctggacagcaacaaggcgatagttgggacaggtgagatcgcatgctttttacaagtacgctaccataccacgtccgttctaaaatataacaaattttaaacggatatgacattaattttaatactataaatctgaacggatctttgttttcatctattaaaaaattgctatattttagaacgaatagagtaccttttgttctgttcatactttcattttaaatttgaaattagagcttttctgatttgttcatactatagagagtaatttaggtgcctcctccaaccaaaagtccagtccatgagtaattgagtattgcaaattgccctatatgaaatatagtatccatcataacctattgcagtttgattgctagtagtctttattatgttatcctaactcaaaagaacacgttttaaatcgcacttcttttccaagacgaccggcctactaccttcgcatttaaatacttaacactacaaactttattcagtgtgcaactatgaccgtcatttttcttttagaaaaaaaatatctaacaaaattataagctgtaaaaatagttgaagagctagtagctttaaaattttaaccaaataaatcacgatagcatatacttaaatatactagctgaattgcaattctcacttttcaactatgtgaaaaagaaaagaatatttttttaactgttttgcggttagcatgacaaaccaacattatatcgacactacaatcaactacatgtactccctccgaactgataatattgttttataatattgttttagattaggacgaggttaaactttagaatctttgattataaattatttttaaaatatttgttgtttatacattgtgattactacatatataaattagtcttaaaaagtacttataatgaaaaataatggtggttgtttttttagatcataccattgtccaaaacgataagttttatcgaagggagtatatacgtgcacgtctaccgtgtaattattcaggaagataaaaaacaaacatgtcacggtaccaatcacaaatcaatcaacacgagtgccagcagtttcacgcaagtgctaatcgagctcgacgatcctgcaaatggaccaaccaagccaccaaagccaaagccatcgtaacactgacctggcgagcgatcgagtcaatcgactcgttttcaacttggacccgacccacaaccaccaccacatgccacaatgcgcgatcgcgtcccgagtccgacccgccgagccgccgccgccgcgtcgagcccgagccgcgccacgcgtccgtctctctgacaggtgggccccacgcggccaacgcggccaccacgtggtcaacggtttgaccggccagcctatcctcctgctcctcttcttcttgttcttcttcttcttcttgctcccgtttcccgattcccactgcggagaagtcaaatacggccacctggttcgctacaacccaagcccaccgccgctgcgaagctgccattcgccgacgaacagctcgccggagaggctgctttcccggagctttgagcttcttggactagctctgctcggattcttgcttggttgggattatcaggtgagtcgtcttcttggttgatttctctggattctgcggatacaaaggttggggattgtcttttcgttgagtatggaattagggattgcttgttcgttgatagtagtagtagtagactgcttcccggtgttgattggttaaagatttgggaatgattcgtgagatagatgagagccccgaattcgatggggggctaaattgagttcttttcttaggttgtctttcaattttacatgctcatgaatggatcttcgattttgtaccttgtcgtgtgtgatcgccaatctgtatggaaatcagtttacatattctgatttttttttttgggtgagtggagaatgtgctaggattaggatgtcaacaacaatggtgggatggaactttcgttttcgctttggagaccaggcctaatcatgcattactttattgtatgttgcgtgtgggatgcagtaggtctaatcatagattgtttctatcactagcagagttagttagactagaaaatcttttttttttccattttcttgaaattagttggtcctgttgacgagcaattgatcggatggtgcctgcccaatgatagcgtttctgtgggtagaaattatgaaatgtagataaattctagaaatatagagcaatccgtactgctgctggctggctctaatagtctaatactatgttagttcatctcacctgcttcctgcttgcattccccgagctttaaacatgttactcccactttaagttgtataactagatcatctttactgatgttggttgagctgtaaccaatcaatggcctattttggctgcttattgtaatttttttatcacgaaacccacataactgctgcatctagtaaaacagttgaagcaaggtcagtctgacatcgagccgtcgtggtaggcctaagattcttgtggtttagctgtaattctggaccttatggacaaatgaaaaggctgcattcattctgtgccaccatgacaatttgcagcactcctggaatgtaacatttctgtataatgttaatcatgaacttaatgtttgaaatggtaagtggctaagtgctcaatatacctttcttcttagctaaccattacctgcattctttcttttcaggacatgatggcagctgttgaaaattgatgacatgcttatgtggatattcacaagtgaaactgtatttgttgaactgcagaattaaggccatcatagtagttttagatttcggtaatgggttgtttttgtatatttggcaagagaagggcaacccgacagcaaagttctcagcataatgatggtagagatctctaaaacagactgcattataccctatttgttgaacatgatttgtccatattcatccttgatatgtttcttgctgaaatatttaacatgatttgtacagacccctctggtgatatgaatataacaaaattcacttacaaggagctttcaagggttactgaaaattttagcccgtctaataagattggtgagggaggttttggatctgtgtataaggtaatataagtagccttcaaagttcaaacaaataagtgaagaaaaattccaaaaaaaaatgaattctcacgtgttcatcatgatggattaatggtgcagggaaagctaaggaatggaaagcttgttgccgtcaaggtgctatctttagagtcaagacagggagcgaaggaatttctgaacgaactcatggcaatttcaaacgtatctcatgaaaatcttgtcaagctttatggctattgtgtggaaggaaaccaaagaatccttgtctacaattatcttgaaaataatagccttgcacaaacacttttgggtatggttacttgaatcgtttctattgctttatcctctcaaatttttacatacagtgctaagaaaaggcctagatattcaaacagtttcctttgtttttcctcttttgttttttcaggttatggccacagcaacatccagttcaactgggcaactcgagtaaatatttgtgttggcatcgcccgtggactaacatacctccatgaagttgtaaatccccacattgttcaccgggatatcaaagcaagcaatatacttctagataaagatcttacgccgaaaatatctgattttggtttagcaaagcttttgcctccagatgcatcacatgttagcacaagggttgctggaacattgtaagtaaactttgtcataagttctttttataatgagttaacaagtacgatgcatttttcaagtaccttatctttttcttgggtatctatggtagtgcctatagcattcctttcagtttaaatggttgacccatatgacagtacaccccgacaatttcttttacattttatgaaatgattgtcagtggaaaagctaaggcaattaaaattgcaaatatcaaatgattatttagtaatttatggattatatttatgacccatcaaatatcaatacacctgcagctttacttactcagttttacatgacagaggttacttggctccagagtatgccattcgaggacaagtgacacggaagtcagatgtttatagttttggtgttctgttactagaaatagttagtgggagatccaacaccaatacaagattaccctatgaagatcagatacttcttgaaagggtaagataaaatacaatacttttttttgttgttccttgtatatcagaagttactatctttttttaccatcatcactaaattatttatttaggctgaagttatatctaatatgagtgttgtatttgttccatgaactaatgttggtgccttcaagtggaagtcttggtttcccataagaggactaatggagatacatgcagttattgcttttagaatcttagccatgacatttcaagttttcagctattatatttgtaaaatcatattctggttttaatagttaacactcttgatcaccgcataatttactaggtgattatttgtgctttttatagaatgtgatcaaatttcacttgacagcctagtcctctcagtagctgtgcagggcacattagcaatgccttagttttatgggtactgctgaatgtgctggttaagataattatttacatgggcacaatggaaattacatattgggagtcgcaaacatgaaagcattcgtgaacaaaagtttggtaaaagtcaaatcattaaaaaatagagggagtaaaattgtcataatgaaatgcgagttgcatgctgccaaacacatcagttgccaactttttcttctacatgaaagcatcatcatcatgatgtaaaagttattcgtgtctcagctagggagcaaatgttctgaattggggcttttgttcttttactgctacagttcccagagatcacaaatggggttctcctcttgcagacatgggtgcactatgaagagggtgatttggagaaaatcatagacgcttctttgggtgatgacttggatgttgcacaagcctgtatgttcctgaaaattgggcttttgtgtacacaagatgtcacgaaacatcgacccacaatgtcgatggttgtccgcatgctaacaggtgaaatggatgttgagctggcgaagatcagcaagcccgcaataatcagtgactttatggatcttaaggtcaggagcatgaggaaagaagtggacatagtttcatcctcaacatccacattgctatcttccatcatggcacactcttctcctttgttgtcgcaagagacaacagaagcctccatgacattcaccgcgatatcagatcgtgagtgacccgaggttgaatgcagatacgaagattgcatcgacaaaaggtagtgtaggagaaatgttttccagaaatctttttgctggtttgatttttttttcgatgtatagatttacttcatttatagcctgaaaagcagtctagagtgaagaaagtacatgatagtatatcttgtttgttcatggaatgtctcctgtttttgaatgtgcaatggacacttcttcagttcttaattgtacacgacaccttgtctgctgcttgtgttctgagataaattgccaaaaagaaacctgtctacacgaacaatgttttttccactttcaacttgtaaaatgacagatcatattattgtcttccatgatgatcatctatccctgtaacgcgtgatgttgtgaagaatctcttgctctgcttcctgcacactgaaaactgtaaactgatttcagattcactgggatctggatagttcagatactgttcatcaccaatatgcaagtgcagccactgccatgctgtctgcaggaaaaaaaaagtcataatgcaaagctctgttgtgcaagaggggacccaggtgtttctcccaatcactggggacattcttgactttggctgcagatcagcatataatggcagtgtcctacttactctcagcactcaccatcagcatcactgtagcttaacctttcctgctttgtggccacataggcacagtgacacagctcctgaatgcattcttgtatgtttgtactaactacagctagtgaagtggtccatgaatgcatgcaaatgcaagcatgcaacaatggctggtccatcagagaccaacacatgagtgagctggaggtcatcaccaactaattgtacaacagtgtagattggttgttcaatgtgaagcacaatattattttcaggaaaagagttatatagaaaataaaatatatattgcccttcagcagacaaaatggtctagatggggttcaataatcaatatgaaactttgattaataaaaggggtcaagcttcggctcccatcggatggcctattcagccaaagaaaaagcaaaaatttgaattttcaaacttaattttgacattgattttgagatattttcaacgtagttttttttcagcattggcttttaagtcaccgaaaacacatatataaaagttttatctacgaaattcatttgtattctctaataagccgttttggcttattacgaaaaaagccaaacgatgaggcctgaaatgcactacaaaattgatttactttgtctgattcaatgagaattactaaacaaactgtgaatatcttgtacaacgttcttcatgtttagcacacgtgcaaactgcagtacaagtacctgactagaaaatactagcatctgagaaaaaaagggtagaaagaaaatagcatccagtcaagtctaaggagcttcgccgttgacaaggataacttgttaatcgatactgacaattgaccaattcgagataagcatgtaatatatccaacaaaaatcaatggttgcgtgcctaacgaacagaaatcggagatgtaacatatttttattatctaaaaaattcaaccaatttagaaggaaattaattacagaagaactgaatgccagctgctagtttatatgcatccagctcatgaggactgcattcatgttaattatgacggtattattcagcagaaattaattaatagcagcaggagttttggttcatactgaagtgaaagaattattgtctagctagctagttctacaaacaacattttttcaatcagagaatcataagaattttgtattgatcagtacaatgacaaattaactaatcacaaccgtagagaggcgtatagtagtacatcattacactcatttcttcaaaaaaaaaatcattacacttacacccagaaagcacacaaatgaaagagtttgtagaaagtttacggtctgtcttagaaatattttagcaaaatccgatactgttcaacaatttgggatgcagctgatcaatttactaggcattgctcaactagacaagaatgagcatatgatgataatcacacaattaatggattctgtccccaaaagtgatgtacccgtatatacgaagtacattgttctaaaacaagaaattaaaataatcggaacgaacaaacgtcaggccctaaatttctttgtcaagaaaatattgaccagatgagagccttgcttgtgcaactagctagctgtatagcttgatcataatttgtagcagaactgcacaaattaaattaaaacctaaaataatacatcttaattatatagtttcagctgcctaaaggaagaaacctctatgcatcatggttgcatacttgcattaattcaagcattaatttaggcagaacaaatatatagcgagccgtttgtgatgaggaatatatcagtaaacacactgcactgttgtgaaaaggcatatagcttagtgattacagtgacctaagtagtattttaaggtcctaggtttaaatctccatagaagcgaatttcagattatattatttaagggctaagttaaaaatgttgcatatattcagttggatgtagaggccgggtaaaaaaatacccttctctaagaaaaagcaagcacacagctggatcaaatcaaatatgtggaatatatagcaagattcctcaacagatacatccaagcaaatgaataattgattaaaaattaacaggacaaattacttgtctacataacatcatgcatggttgccttcaactttcattattacatggaacatctatttagctagccggaataaatgtataagttaagccgtttcaatgaaattaacagaagtcaggaaatgttcttcagaattatagcatcagtaatcatgccatatataaaacccagaacaaaaacatgcataaccattacttaaaaaataaacattcaaatattatatataacctcgctcacaagtattccaaaataatcaaacttggtcagtgaggaatgaagatgaaacacatccttcttgcacctgcaattaattagaaccacaccaaattaagatcaaagatgtaaaggcacgaaaaacttacacatgaacacatacatacacaaatatatgtatactacatcaaatgacacttaaaaaagaagctggaattaatggatatgtcaagcaaccatatgcaggcaggcatgcatgcttggctccttgcacgccacccagtaggcaaccagacaccatgggttggtctacatgtgtggcatacagggagccaggcacacactacacagcttctgaacaaacctctaaacctcatcatctcatccagtgtaaataaacacacatgcaaacatcacagtgcaagatagtaataaccaagagaacagaaagggagatataggtacaacacatgtttctctctttccttccatatgctccatgtagataaatatagtgaactagtgatgacttaaccagatattgatgcatacacaagctagctagctactaggcatatacacacagttgaagcaaaggacaagaaggctactagagagatagagatacatatatacagctatatgtaaatgttcagggagtagaagtgaagaacagtgcaaaggtgtgaaggattgaggtagaagaaaggaggtgaaggtggatttatagatggagcaagcaagaccagggaagatacaacaactcctctccatggctgctagctcagcagcttatacttgctctacctcctcctactagctgtttggcataaagtgaaagcaagtgcaaagggacatggagcacaagacactaggatacttcccaagggggttaaaggatgaagcttttgatgccatgccacactacacatagctaagctagctcagcagtactagcagccctacacactgcaattttactatactatatactccactgtctttccaaaaaaaagtttcacactttcaataaaacatactccctctatttttaatatatgccgtagttaactttttgagatatatttggccatttgtcttattctaaaaaatatgtaattatcatttattttattgtgacttgatttatcatcaaatgttctttaatcacgacttaatttttttgtatattcacatttatcaaaaagtcaatggcgtcatatatcaagaaaacggaggtaataccacattatatagtagcaccacccctggcaaccaatggcatattgacatgcgaaagaatttcttaattaagctccagttctctctatatatagctaatggctatatctatccatctatattgggctatatatatatatagctcatgcatctctatataatctttttcttatctcgatatatcgtgcttggccggtgaatgatgacgatgagagagctagctagtatgcactacttactcgtgttagctaggctatagctagctttgatgagttaattagcagctatgagctaataattaattaagcatccagctgctacgctggtatagggcactgttgatcagccatggctatggcgatcgatggcgactacatggagcaaaaagaaaacgaattagccttgcacgcatgcgtgcaccttcaattcctcccatacacaacaaactcagagtcacagagaagagagaaaaaagagagagagagatggtgaagactactgtaaaagttgatggctctgacctgcagtgaagtggattttgtctgaagcacttggccgagctccagattcttttataccaaacctcaccatgcatatatactatacgcccctcttttcgtttatgcttatacttatcagccaaaatttaaatttttaacattaaatttagagttttttcatcgaagtttatttttcagcctttacttttgaatcgctaagaacacgtatataaaaattttattcacaaattatttttcgtttacaagtatgccggtttggcttataccagtcagtctcaggcataagatccatgtctccctagctgcagggtgcagctatatctgcaatgtatatgtttatgactgccatgagcggctgactggtgggtccgggttatgtatagcaccccactgtcagagagaggtgagtgactacatatgtgttgtctgagtgatgtattatagttataaaaaaaggaaaagaatgatgtattatgatgatctagctagggctgtagtctgtagatagctccccaaagcgatgtaccatgagcaattggtaggtacggagtacaacactgttgatgatcatggctttggaccatgcatgtgttcatgttactgttcactccagcttaattaggggctgtttagatacaagagtataaagttttggcatgtcacattgggtattatatagggtgtcgcatggggtgttcgcgcactaataaaaaaactaattacagaatccgttagtaaaccgcgagacaaatttattaataagcctaattaatccgtcattagcaaatgtttaccgtagcaccgcattgtcagattatggagcaattagacttaaaagattcgtctcgcaaattaatcgcaatctgtgcaattaattattttttagcatatatttaatacttcatgcagacgttcaaacgttcgatgtgacaggttgaaaatttttagagtgggatctaaacatggccttatacatgttccttttgttctcgaataattgacattaacactatttaagtttaaactttgacagttttttttctttccttagaaaattgatagtgaatacttaaaaatgtattatatatcattcgagtactatatgtggcatcctaaatataatgttacagtcttcattcgtcataatataatcattaatttcaaagtaatttatagttcaagtgagacggattcaagaatggaagtactactatagtgttgtacacactgacactgacactggctagcttcttgttgaatggcatgaactgttccatcgcgtacgtctattaattaattaatctgtctatatactgttaatctcgaggggtttgagacttcaaaattaacctgcaggaagagcggccaaagcacccactttacagatcacatatgaccaccatttaccagaaaacattgttaaacaattgattagtttatcagacagctatcaacaaagatacaaaatctttctttcactataagcatgcccaacatctttgacctaacactaggtcctgtctgctcaaaataccatcacatgcatgcatcatgaccatttttaataattataagtcactcatgcagtagtcattctacctaataaaccatttgcaactaatgcccagttcttgcctagctagcttcttgcaggtctcatcagtcaccactcatattcttttgactggtagaacccagatatataagtccaatgttcaaaaattgccagctgatcatcaaggcttgcatttttatttttttcatttttgaaacttgatcaaagctttgcattggatgggaagaaaagaattagtaatagagtcatgcatgtacacctgccaatgcaaaagctagctagctaccaccaagatgtaaataactgggacaatattatatactgcaaaaagctaactacacgcacgcacgcatgaaaagatgcatcggtcgtatatattgtggacttgtggtgggttggttgatggtcatggaggcaaacccttgcagatggcttgtagcaattggtgccttctttccatgaccatgtggaatatatttttatcctatatcttctcttttttatgtcacctaaatagttataaagaaattaatagggtagattaatatacttttatatatcactttacaaacatgaaaattaagcttctaaagttataacagaaaattctaacctctatgagtagttcaaattgatctaataattgtgttattctagaggtttttcatgtatatcttggtcaatgatcccaaacttatgacataattaattgcaagaggaaaaaatcatatatgatcagttgattcataagacttttgttgccacctacaaaatattgacaggcagccaatagtctttctagctagctgtatattcagactatatacatgaacaattttgtagaggcaaaacgaaaagccccaaatctttcttttcaaacgaagatatataaaagctagctataggacagtactgaatctctctgccttgttcattccatgctttttgtaggacgtacaaccgcccaccaccgttcgttgaaagggctggccggccccggcagcatgcagctagcacgattcccattctgattgtctaatctaactaccacatatgcatgattagaacttgaacccgagcggacaggattaaaaaaaaacccatatccagttgagctacgctcacttcgcttaagctcactaatctaactaccatgctcaagctcaccgaccaactcatgctgacaatcaaacatgcacagcgaaggagagacagacaggatatagcttagctagctagcagcctagctagcactgtgtgattatatatataccaagagaaatgatcaaagttggggtagcaagctaattaagacagcatagtatcaactggatgggtttcttgtggtgaaacctatccgctcgggttcaagttctaaacttggaacgagtgcttatatctacagtactttttttcaatggtagatgatgtacctgtcgacagtaagacacttatggtaacttcgttaatcttaaaatatatcggctcaatcttctaaatgtgcttatagaaatagagtatatgtttatagggctgaatgtgcgtgcgttgtgagcgtcttttgtagtattgtttttaaacaaagttagtgaccttaaggattgagacacattgataaacaaagaaactgataccggtgtgatgtgcccaattatttgagctttaataatattgtgccacattcacttctattgttatacctatacatatacttcactacttctcacctggacacatgatatatgtccaaccaaaagtccaaaacagtacttagggtctactattgaacagtgcatgtcattcttgttggatgcttttacttcgatgggtgcagatgtcaatgatagtttaaaccatggtggtggtccttatgtttttaaaataaatggccaggttcatcaccgtattgatgcattgttgcccaatgaaaatactcctaccaagtatactcagctctatatttatgatacccaaaatgaaattcagaataggatgtgtgctatccttagtgaaggtggcgatccttctgctttagatcctgttatagctgctgagctaatgcagatgctagatgaatgcattcctttggtaaaacaatttaggttagcaagagatcatttggctgagaaggtgatgaggaaatagcaattaggattgttggctctgatgaggatggtcctgtccagtacgagttgccgacagctgatgagcttgcctgtttgattgttggtgatttttcgttagaaaacctgaagcgtgatatcattattctgaatatacctggcccattgcaccatgtgtctagcctacaccctgcttacatggctttacagcacccactgctttaatttcccctacggtgaacacagttttcaggtaggtataaatttaaggggggttgatcttactcgaaccgctatacgtacaaaagcatcaatgcaggaattccattgttattattgtcattaccgtcgtgatcagttcaatacatatttatattgtggtcggttgtcctctcaaggccaggttgactgctttccttgtgttgaggaaggtaggctaacgtacataagagaccatcagggtgattttagatgcgaaaacatttaagggattgcggatgccgttggcagaggatgcttagatggtggtgttggtaaacaacgaatattgcctacaagctttactggtgaaagaaggtacatgtattagaactatcaagatgcagtagctatatgccgtgtgtatggtgcgcctgatgtattcacaacatttacctgcaatccaaagtggtcggagattgaagaggcccgactaggcgaggggttggaggtaggagtaagcgtggagcgtacttggcgaggggttggaggtgggaggtcggtccagccgcagtcgaggaggaagcagaagccatcgacggcgagtaggtagcagaggggtccctcaccgtacgccccactcaacggagtcacctgcaccgacgttcccatccgatcgatccccttcgccggcggcggtggcgagcaagaagagttccgctcagagtggaatgagagagaaagagtccaagtgtagtagttgggccgctcaggaggcctatgcaaaaactttacatgggccaagctgaggcccatatacttccccttttgtgtttgtttcctttcctttcctagtagaggtcgagggagggttgctttctccacttgcgttgcgtccgctgccattgtcactcttctccgtctccgtctccatctccggtcagatagccccttatcgccggcgatctagaagcgagaaatcccaacaaatagacagccagagaacctgctcggctcggctcggctcggtcgccttccccttttctgggagttggcttgtttggttggatctaagcaaaggcctaacccgcggtgatcttccgcctcccatcccatggacggcgcgagcggcagcggggagccaacggccaacggggagaagaagcccgacgagcaacacttcgatcccagccaaagtaagggtctctctctcacgcacctttaatttttgttaccttttgcgttcgtgcactaggtttggttactcctattcagtactagagtacaacaaatcacgactcatattgatcgctttagagggttcagagtttgtaaactagtattggctaactaactattcgccacgaatcaaattcgaaatctcacagttgcaggaaataaacatctcctgcacaactaggaatgcacaaagatcctatcaaatgccatggccatggcctcaattttcgtagccccctggtccataattcagttcactaataaagttttctgagagatgtgcatatataggatggtagttcttgaaccaacatcacagtttattcgggatgaagtccagtatattgcaaaaaaaaattgactctgtataaatgattggagcaggtatcctatgctactagatactgaatactacaatgttatgcttgtagctaccatgctactagtatattgtcatgagtgagttatgaaatgtcaaagctttacctctccatgactttcacatagtacactggcctctttatagtacttagagatattttgagttttattgatgcattgcttgcaaaatctacaaaacattttccatatgtaaaatagttgccagcattcttgtgcttgtgcataatgccatgatgttttgaagtgataggaataatcaaaaggaaggccttgattaaagaactggctgctgcttaccatgctgagtgtgtggcatgctgtgaagagcttctgcagctccagagaaagtgggaggaggtctgtatctgtccttctccaaaatggaagataatcctgtgatttgtattcctcccattgttgtgaaacggaacatatataagtatgtaggaacacgaatcctgctcctcttctgtcggttgtgcaggagcaatatgttgaatttaagatggctgatgaagcgccgaggacgttgatggtgaagtcttccaagcgcaggaaaagatagctttacaaggcatgaatttgacaggagctctagatgttggatggatctcctacaagttaaacagaaagaagctctatgtagtttgatactttttggtagatagtcagtctattctgggtgctcgattgttttttaaacattgtactagctgcttcagcttgctaggggtatcaacttggccgctgtatcttcgtcatctatactcggtacagtactcccaccatattttaatatatgacgccgttgactttttgactaatgtttgaccattcgtttcattcaaaaaaattttgtgcaaatatgaaaatattcatgtcatgcttaaagaacatctgatgacgaatcaagccataataaaataaataataattacataaattttttgaataagacgaatggtcaaacgttggacaaaaagtcaacggcgtcatacaatatggagaatatggaggttgtatttgcttgaggagtggaggagcatgttgtttctgttatcagctacaggaagtagttgccctcagatcttttactaacacagacaaaccctcacattctttctgtaaaagcagctgggtacaatccaacctctgcaccgcgttccaaatgaccattttcgatgcttctacctctgtttttggaaaatttggaatcacgtggtcttcgaaaacttgcctccatcctgcccaaggctgattaaagtctgctatgaagacgcgatcctatgggaaatcgcttaaaagtttcagaagaaagctctacccaaggctggaaggttatcttcaatacccaaacttcaatgtaactcgtttctatgtaatccctccacccctctttctacctgttgtaatatttatttccttaagtgtaattgttctttaaatacttttaattatctaattataattcaggtggggatgaagtttttttttttaaaaaaaaagaaactactaggaggtcactattgttagtttgttactactagtaatatgcccgtgctaacgctatggtatcattgtatttttataatattccaagcaatctttatacataatattttcggtaaggttggctccttgataaagcatagtaaagctgtccatgcgaggaatatatatatatatatatatatatacatatatatatatatacatatatatatatatatatacatatatatatatatatataatcatttgaaaccatgaataccatcactccatgtcagctcataaccgtgacaacgccgatgtaatatatttcctaaaaacaacagtaatgatctttaataaacattttgaatgccttcggaattaagaaatatgtattcagtccgtcttcctgaaataaatattatgtacacaactaaggtctagaattacatcacttcctctgtttccattatgacattttctcaataccttacatgcaaaggactaagatacaaatcatacaatcgaatgctgttctggttgtcaaacgaaaaggaaaaaaatctaccaaattatttgtatggtttaaataaaaataataatagtcaattatatatgacacaaaatttggagcaagattcagaaaaagaaaacaacttgttagataaatgaacaaagctcatttaatttgtcaacataaagctctaatggtccattgaaccagttacaaccagaagattgatgtaatgtattagtagtaaattcatttcgcatatcaaattgcataaatgattgatcgggaatagaaaaatctcctagtctacaataaaaaaagacatctttgcagaagttgtttagtaagtacttaagcaataactacatggccaacaaattgcactttttcctgccacgtcagaagaatttcacactcatcaacttctatagaaacaaatgcctacgagtgtcataaccaatagtaaaaaatatatatgtagagtggcactatatctgaaaatttatttactgatcgtgcagtcggtcggtatgaaatgtgataccctcaaagatatttgatctgcaacaaattccctgacctacagatccacatgaaatgagaaaacacaaggaatgaggcactttcagtataaaaaataaacaaaattatttttatagtggatagctcacctcatcaaagcctcttagcaaattcttctgccaagggaaaaaaaactgaacatcactttttaagccattgaaaatgccagcaaactccaaccaatgtaccctcatcctactatcgcaatcttctcaggtctgaaggcaggattaataatgctgcatctgaatcattgacatgctctattcctagaatatttgacatggatgaccgaccaccaactgctgtgaagtaaggtgctcccatggtgaagtacaaattgcagtgaagtgcaaaagaaaacatgcaatttagttacaaatgtatttgagtatgcacagtaaaccaaaactgaacgcaagcaaaatgtactaacttctgctggaaagtcatagtcattttacaacatccaacattactactaagctatgaaatctcaaaaaattacttattgatggcagggagtttcaaggttggtggattccgatgatacacttaacattcattggtctttctggtattatctaatactccctccgtttcagtttacaaaacgttttgactttggtcaaagtcaaactgttttaagtttgactaagtttatagacaaatatagtaatatttatgttggagctacaccatgagggccttcggctgagtctaccgaaaccaagagctcaggcgataaactcagaccggaggtgagcgacgaaggtcgaaaaggcaaccatatgggcgaaagccacatggcgaaatccgtaactcggaatacgtggacttcctaggcaaagacctcgtcaaaaggccgcatgggcgaggatgatggggcgaaagccctggcacgaaggcatgggtttcaccaagtaccgaacttcactaggaggaggcccagtgggccgttgcacctttgagggacttcggcaaataaatgggccaagccatttggcccaataggggcccatacatgtaaaggacactatgtgccctcaataatgtctctatcataagggtaaccatataaattcccctgtaaagcctaaaccctaaaaggagggaacctataatagggctataagtagccccctaaggccatgtaatggggggatccaaaaaatttttacaaagcaatacaattattttcttttccaactactattgagagaaccacgcctttcgacgtgacgcagttgtccattcgacaacaatttataatactaaattagtgtcatcaaatcaataactgaatatattttcataataaatttgtcttgggttgaaaatgttgcttcttttttctataaactttgtcaaacttaaatcagtttgactttgacaaaaatcaaaatgtcttataacctaaaatggatggagtagtagatattgttactagtgactaactctttacctttagcactagaaaattcaataaaatgctaaagatagatcacgatattagtttagcccaaatttaaaatataacgattacattaagaaatatcatcacctatttatcattccataggcagttcaattagggtctcacagaaacaaaggagaaaaaataaggatttttagacaaatacggttcactacaaattacattttaaattaaaaattcgtttaaaggtcagtaagtatttccagtgggtggcattacaaacacatgattcagtaagtatttccaaaaccattcccacttagcgtcagtcacaatagtttttaacacatcagtgaaatcaaacttcaaatgctcaaagaatagatgggggtcttttccttcttggtcataatatggacgcaagaggtcaaataaccttttaagatcctttgattttgaatcagcaggagcagaacactggccaaccattttcagcacaacctcattgtctgctacctcccagtcacttagctcccagattccatcccatgagatccctactttgtggtttttgatcaagtgctctaggcataactgaaacacagcgcttcccagtctgctaggaagcaaaagcttggtgaagatctcgaccttttccaagatcgcctccttcttctgattcagaaactcttgaagtgttgaaatactgcaaataataacaacacaagcaaataaatcatgacaatatgaataactacattcaatgtttatttaaaaggccttcttaaaaaacaattacctacttgtttggcattaaggaaaccaagttccactttctatgtcagtcttatgttttctgactttctctgtatgggtttcatcagactggtcatcttggacacagaatatttaagaagaattgagaaaccacctgcgtcagcattgggtgcagcctaaaatagagaaatttttgttgttagcaatcaaagcaggacaatgcacagggctagaccttttgagtatagcctatctagcatactgagttactgacattgttttttcattgcatattttgaatgctaggctcaaatccccttcttttaaatggtcataattcacctagaacctaatgcgagatcatttcctcgaaattatcgctttagcttcagcagcatcgatatattttaagattgacgaagctatcacaggtgtcttactgtcgacaggtacatcacctaccattgaaaaaaaactgtaaatacgagcactcgttccaagtttagaacttgaacccgagcgggcaggtttcaccacaagaaacccatccagttgagctacgctcagttcgcttaagctcactgatattcaattgcaaatgcccctatgtcatgtacgtaggtaccaggatttaaattttgatgggtgaaatcatatgctgataaagccataactacagcactatctatgccctttttttcatgtgtatggatttcactcttatcaacctcaactaactactaccgctttcccaagatgtaagaatttttttagcggacacgattattaagaaaataggtaaaaatgattagttgtaaggagatggtaagtagataaatagctttatttaatataagatattatactagaataactttattttggaacggaggtgtagtagctactgccttgtttaggggtgcagacaatgagcggattgcagctctactcctgagcctaaagtccattacaaattacattcaaaaccttaaaatatagaggaataaagataaaattatgtaaattacactggtatatagttctaggtctgaaaaaaaaatcaagctacgtccctgggtgcagcagatagaagtgtccaatgggagtttgcatgcttttaatccagtcacactgcacggcacggcagcacattcgctttcacgtgggccgccgtttccgcaacgaaaggcctaagcgcgtgagggcccatcagatcgtggtctcgttgcgtggcgctttcctctcgacgaaacgagctggcctaaggcccaacccggtacacaggcccaaggcacatcttttgggccgggcgggaaaaaatgcgcttatgcaattccaggccttttgccaccttgctcacttttaattgcgtgtttggtagaatatatgatcccatctataacgagagaaagaaagggagaagaggataaaaaaagagaaaagaattcgaaaatcctaatgggcgatcgttcgccccgcgcggtcagcctcctcctcaacgtggtttcttttttttttcaccgcattacttttctattttaataaatttatgcaattaaagtttgtacacatcaagtttacacatctaaagtttatacacctaaagtttataagtcaaaagtttatatacctgattcaaatttgaatttgaattcaaatattttttatatataggagtatttctatacatctaaagtttatacacctaaaatttatagacccaaagtttataagtcaaaagtttatatacccgattcaaatttaaatttgaatttaaatatttttatatataatatttctatacataaagtttatacgtgcgaagtttatggtataaagtctatacataagtatagagtctatgcacataaataagagtattatatttttttctattttttatttttttttctaactttgtttttttatttttaaaaatttatggtgtagtagaaagagaataaggggaggatgaaggggggagaggagtgtgttaggggagggatggggcgataacccgcccattagcgatgcccaaaagaaatatcatgagatgtttgacaattcgagtataactaaaatctactccagattgcttgtacacacatactgaattactgatcatcgatctcacacctaaccatttctcaaaggcattttctgtctatactacttgttacatttccaactaaaaaattactactccaagtactaccaaatgattttttttttcaatgacgatggttgagtaaatctactgctggaaaaagttccatgtttctgaagatccattgtcagttagacagtagtaatcctcgacctgttcgtcttcagacaaatccttcttcagagacatctccctcttcactgcaaggtggccatcaaacctagtagtcacctgatcattctgcacatctctcatcatcttcttgtctgaataatgccgctgcccttcagacaggtggtgataatcttgatcatcatcagcagcagccgacgcgttcatcgacgccggcgatggctgctggtgatgagagctagagaagcagggaagaacttcctcataacctccatgattgaaggagatcgagctgtcaacgaggggtggcaatggagatcttgatgtgccgccattgatgtaacgaggaggaagagtagactccattgttggtgctgcaacagcttctgtcctgctcttgtagaaaaccctacacagcacccaaccctcctgcatgtactgaactattgatcaatcacaaaaaaaaaaattcacatgcagcgtgtgcaagatgatgtcaggtagtaataaatgagaagttaatcaacccgagcaagagaagatgctgaaagaattaatggcaaacaatcagtacaggttcagttctctgaattattgcacatacaatgtactgaataattaatctgtgttattcttgtatatggagagaaaaagatcttgtatacgaaggaagagttgtgcatgcatctagctagttagtcgtagaatgtatctgaaagtgacttgctagtaatagtagatgtctgatgcgtacgtctagctgccagctggcatgagagtgactgataatgcagtcaagtgcaaactgaaaacgaaatctatgggcaagaacctggtgaagcgatcaaattatttaatcatcatgaatcttcattataccctttgaattctaaaaccacatgcttttgcgtctacacaaacttactaattataacacacttgcatgatcacttgattgtgatgctggcaccaaccaagacgaccaattattataaccaaatcttgcatgtatactacgtccgtctaaaaatataagaatttatatatttaaaatttattcaacgatataaatatttagaagctctgatgccaatacatgaaaagcaatatatttttcatcctaacaggtatttgggagggaaatctaagtaattcaaaatttaaaaaggtaaccattgtggttatcggaaaagggaatatttcccccaacattagtatttgctaaacaatttagaaacgcttatactttacgagggtataatgatttgagcactaattgattattaccttgagatgatgatggtgattggcatggtctaattcttgacggaactcatgcatgacccaatcagtcctctcacccttgggggctctccctctgtagaaaacgagcgtcttacgcatgccaaccagggaccctttccgggttatctcccggtcttttccggtggccttccagtaccctgattcagtcgctctgtttgttcgttgccctcttgcgtacttcctgtccttgaggttgtagaagtaccattccttccctccaatgcaagcaatctctacatgaatgtatgtatgtacagccaatgcaagtttgttactccacatgcatttcgtttgtaataataattatttgataatttaatgtattatcatttttagttagagaggcaagagaagctaaaaaaatggacagtaatttaattcagagtttattagcacctacttccctgtttcaaaaatataagtatttctaggttgtttagcaaatattaaggttaagaaatcactttggtggtcaattttaaaaaaaatatggattgcttattagaatccccttcgaagcgtgtctgattggctggaaatgtatggatttccatacattagaatcaatgtcagaaatatttacattgtggtataaattttcgaaaatccttgaaaaatacttgtattttggaatggtgagagtaattagctaggatatatgaagaagtttctagctatatataggtcaatgtttttttgggtacctcacacactagggatgttttaacaagcaaaccggcggctttgctttctgcaacagtctctatcttcagtttctctctaggttcaggcaaaacgggaggatatgctatgggtagagaggaagctgccaaacaaactctctcggcaaaaggaataatattcagtctgttatatgatgtgatgaggaagacggcgacgagtcaacaagcaggcaggcgagacgtgtaaattttgttctcattatagatacatttttcgataattagattgcatatagcctcatgaacagaaaaaaaaatataaatattagggaatgacctaatatcaaataattaggtctcaggtcatctagcccaccaccccgtgaagctagccggaagacccctagacgtttctccttacgaacagaaaaggttcaggtagtttcttaattgtggaagaattaaattcaggtggattaatttatcagtggaaagaaatgagaaattaattagtgagctagctagcttctgaaatttcatggatcgatcgagttaatccaattccaaaatgcattatcgaaaataaattccaaaataccttttgtcgatcatgctttgtctagtcacggtaaagaaaagaaacaacttatactacataaagtttgaaatcgaatttaggtcagctcatggagctagagatgagttgaatcggtcacctcaacaaccatgcttcgagatgcatgaggaactaatactactaaacttgcatcacatgcattatctaaaaagaaaaccttaatgttcatcttacacatagaaaaattgaaaaatttaaattatgatgctcacgaatattatcggccccatcgtttggcttattcgtggaataagccaaacatcatatttgcaaacaaaaaataatttgtgaataaaacttttatatacatgttcttagcaacctaaaagtaagaattgaaaaataaacttcaatgaaaaaaaacctaaaatcagcttcaaattcaagattgaaaattcaaattttacctgataaacataagtataagcgaaaatattaggccatatgtgtatggagatatgctttcagcaagattttaataagattgaggatgtgacgctggtttttatctctttaaacgtgtattacgaggtgcattcgcgaggtgcaagtgtggtgctacgtgtgtagtggtcgtgtagtgcagctgacgtgtaatcagaaaaaaaaaataacgtgcatcttgcatggacacaccaccattatcatcacgttgcatttagtagaaaatgtaatacagaaaaaggctacaaacgcccaatacaaaatcaaggaaatatgcatcctatagaatcaaacgttaacgagaataaacaaaaacatgtaattaactccaaaaaatgtcttaactcctatagaatcagacgttaacgagaatcaacacaactatctataaactatatcagaaaacaaacggttttaccctgctaaattaaaccaccaataattacacagctttacaagtgcttgtgatgtggtagaaatcaagacaatttactagctagcaaaatcatgcaggatgtatacctgggaggtcccatggctcgcacttgttgagatcgacgtcgatcagtgtcggcgtcgggcagccggcgccggcggcgccgccgccgctcgccgcgccaccgtcgccggagcggagcttgccggagaggtagtcaaccacgagttcgtcgtctcgaggatggaatctgaacccgggaggcagcctcgcctccaccatgctcaagctcaacgaccaactcatgctgacaaccaaacatgcagagagaagaaggagagagacaggatatagcttagctagctagctagcactgtgtgattatatatataccaagagaaatgatcaaagttggggtagcaagctaattaagacagcctagtatcaaagatagattaattagttgaagcccaagtcagaaacttctattcgtgactaatcatggaattgaagagatggaggttgtgtaatactatctccgtattttaatgtatgacgatgttggcttttttccaatatttgaccattcgctttattcaaaattttatataattattatttattttattgtaacttaattcatcatcaaatgttctttaagcatgacataaatatttttcatattttcacaaaaattttaaataaaacgaatggtcaaacgttgataaaaagttaacggcgtcatacattaaaatacggagggaatatataagaaaagtctatactacaaaactttcttacataaacttttacaaacactgatatggcatggtgtgtaaataaatctatatttcctgtaactaccattaatattatattttgactaaatcaaacggttgagagttttgtagatgtagcagtgttagggtcgggaaacaaaatgttgtccaactgtccatgacgcaacactgtcaggcggctaacgtggcatgcttaatttggggccttaccatctttaacctgcaagttctacgctgatattgacacttgtatcggcactaccatgatactactatccatgcacgggagcgagagaaaagtctataatttgttgcacctttctaacaaatcagaatggttgatgaagaatattaacagcctgtggaagacaccaaaccatgatcactgaataattaagatgttggaagcatatatacctgaaactgaataatctttaacctgcaagctgaacaggccagagcacctccgccgcaaagcacacggcatgctatatctgacaaacaaacaagcagtttcagtgttactgataattcttcctagagtgaatttgagaacaatttgcaggaggaccactcgtcgcgatcactgaacaattcgagttcatcagtctccacgttgcccgacgcagtgcattctctaaaaagcttcagatactctaacgtcgcgatatctaccgttttggtataagttggttgcactcgttcaaagttgatcagcttcttcgaatttcttctaatgatgattaattagcatccaatggtttgagttttgctgacttcagcagatcattcgtcaaaacaacgacatatacctgaaaccgacatagacgtgcttcaaaaatacctgcatttcagtctattcttgccccgacatagacgtccttcaaaaatacccgcatttcagtctattcttgccgaggtgaagtataaacaataaaaaaaggaaactatcaactcagagaatccaaagtcaggatgcatattttctactattctagaaggaaactggagagaaatctgatggccttatagacgtttagctcagtttcagtattactcccttcgtttcacaatgtaagttattctagcatttctcacatttatattaatattaatgaatctagacatatatatctatttagattcattaatattaatataaatatagaaaatattagaatgacttacatattctgaaacggaggaagtatcaggtaagatctgaacagaaacagcctgagagctgataccattaattggtagcgaaccatatttgggcttgcccaaacgtgaagcgtgggcttggattgtgcatcggacggcccatgaatttgggctcctactccgactgtaagcccaacacggcctgcagaaatgatcatcttcgtcctaactgaagcttacagttcattattattagcactgtctctttaatctctagctagcccagacatgattatgagctggaagaaatttgacaaagcaatctatccatccatcaatccgttaattcctgcgtcaattttggcatcctgcaggttcaacccccgacacggtacgttttgtttaagcaaaagcacaggcgacaaagccaagccaaagattaacaacaaaaattgttccttcctagcagtagctgcatgtaaaaaatatacagctatatatagattatctaggagactataacatcattcacatgccaacatggctagctacatctctatcgaccgaccggccatctatctcgcgatgtgtagagctataaacaaacagctcttggcttatgactgatcaacacggattagcagcttgattagcgtagatcgatccgtcgtcgagggagatcgatcgatacggttaattagggaaggaaacgtttagacaaagcgtagcagcgtgtcagtgtgactcagagcagcaggtggctggtaaagttgttaaatatgtgtatgcatttagtcttttaacaaactctaaaaaatacataagaaatcctgctaaaatttaaaaatattactaaattgctaaaattttgataaaattcattttaactacaatctgaacatgctgtagtaatgaatggacacacacatgttattttgtctggatggatggtgcgagtaggagatgagccgtcacatgagttttgtggctagctacacgggactggatacctagtctagtgtgtctccacgccctagtgccatttctttttagaaaatctgcaccgatccatttggagaaacagagaaatgatccaaactgtgatcgatcaatgcatcctcctcttatcaacaatacctcctccgtctcgtattaaattcaattttagctatttctatttatcttaaaataaatttacttttaaaataattatttgtatcgaaatttataaaagtatgaaataaccgtattgggagtagataaagtgagagatagtacgtggatattctaatctttttgttttttattggtatacgtgggatggatggaaaatgaatttattttgtgatggaggtagtactaaactttgatattgctaaattttactataataaggtactccctctgtcccataataagcacagttcccataataagcacagttgtgggttccagtgcccaacatttgtctatccgtcttatttgaattctttttataattaatatttttattgttattagatgataaaatataaatagtactttgtacatgacttaatttttaaatttttttataattttttcaaataaaatggacggtcaaatattggacacggaaatttatggctgcacttaaaataggaatgaatgagtataattattgtagtattagtattttattatttgtcaaatgtaagtcaaagaccacaattattaggaatgaatgagtataattattgtagtattagtattttattgtttgtcaaatgtaagttaaaggccacaattattgtgccttaccatgtactcctacgtagttactgtgacttttttgtgatatttaaagttttgaaatttcatttttcggagatgaaatttacgtggttttgtcggttaccatggatggttgacaacctccccatggacggtatttgcaaaagtacgcctagtttgatgcccacgatggatgtgcagccatagctaagggaaccgaacagaaccccatagtatttgttcctccctccgtccagcgttatctttttaagaaaaattaaatccagtaacatttgactaataactatactaattatatatatgataaatattatgtatgttatatcactgaattcatattttaaaatagtttcacgtgatgcaaattttatacttggttggaacataacatgaaataaattaattatcaaaacatatcattaaaaaccgtgtaaaaaatatagtatgcctcataatttaggatggagagagtattattactactactcctttcagttatcaaactcaacatcacacatactccacctgttccaaaaaatataaatatcgtactaatcaagacatatattatggtactatattggtttttttacagagagagtatactactaatacttaattatctctaccctattcagtagtagagtagaagtatgcaaaatttgtcatatgatcaaattttggtgcggctaattttaacataaaaatgaattgtactactgcatttgtttgaacgactctggaaacgcgcagatgatccaaacatcgcttgccatttcaccgcaattcgaacagtggcactggcatcagtatcaccaggatgcaatgcaatgcactgaatcgcagcggccgtggttgcagcgaaacaggcgtaaaatcgtctcgtttagcgagccacacagctgatcacatgtgcgtggatgtgcgcgcgcagcaaaaatattcgccgctaaacgagaaagcctaacctagggcgtaggctaggctgggctactgctgcttctgataacgaatcggttaaactttagcccatgtctcataaacataccccctccgtaaaaaaaaaaaaaagttaaaccctagatttccgtgtccaattttaattgtgcgtcttatatgaaatttttttataatttatattttcattgttgttagatgataaaacatgattaatattttatacgtgacttgtctttttaattttttcataattttttcaaataagacggacggtcaaacgttgggcacggaaaccagagtttgtctttttttgaaacagagggagtaagtctctagaggagtgacttatgcttctgtaagagggacactttagtccctagttcgcaaacaccccctatgcctaaacggagatggatccatcccgtcccattgtgtcatgtcgtgtcggctacgtgcttcatccattttttccgttgcatcgttccaattgcatcaaggcttggtggttgtgtttagttcatttcaaagttgtaagtttgggttaaaattggtacgatatgactgaaaagttgtgtgtatgacaggttgatgtgatggaaaaagttagaagtttggatctaaacacagccttagttactaactttttcctcaaacttctatttttttatcacatcaaaattttcctacacacaaactttcaacttttccgtcacatcgttccaattataacaaaacttctaattttgatgtgaattaaacacacccctaagcggagattttacttcagtcatcgcatttgtgaaaatttagaagttttaaattgtttggatacctcttgtaagcatacgattggttcgaaatgatttagatttctgagtatttggaattggtgtgatttgtgcagttgagatcgttcgtttagataattcatcggaaatattgttttctccgtcggcggtataattctgatggaggaagcaaactttccgatgaaaaacgatgggtgagataggtgagagatagagtaacatcttagcgtcccattgatttggagaaaataattagaattttggagaattttaatcctataaaaaaaatcctatgaagcactttgaaacaaatgattgaatcctattcaatcatttgaaattcctatggaatggacatttctatgtagattttggaggaaatatagcaagagcttcaacctcttggtaactttccttggagtctacctctctcattcaattcctgtgtttttcctgcggttcaatcaaacagtcattctatgtgtttttcctacgttttgcaatcctctattttacacttacattcctatcaaaatcatgttttttcttattcctacattttctcaatcctgcgattcaaaggggcccttagtaactttctgaaaaatgatactccatccattccttccataatataagacataactaatttttaatttatttcatcataatatgtgacgtgcgtgcatgtcattaactagcacatctttttgactaaatttttttatttaaatattttactatcaagatctctaattttattaggtgcatctattctatttattagggtaatcctaactatgatgtgataataattatttactcgtctttggattaagattggttatatatcttatatattagaatggagagagtatactgttccttctaaaaaaatggagatagtatactttattgtggataaaagatttgcgcaatggtggcagaccagacggtagcgtccgcacacgggagggcaaactgccgacacgacccctccccggcgctcccaaccgacgaaacaatcacgggcacgattccttcgctactgtgtgactgacacgtgggggccaccgagccagttatactagctggacctatatcagtactccatccgttaaaaaataaatagtacatgtgacatattatagtaatacgtatttaaacagtaagagtgtttagttcacgtcaaaattaaaaatttggttaaaattgaaacgatgtgacgaaaaagttagaagtttgtgtgtgtaggaaagttttggaattaattctaaactttttcttcgaacttccaactttttctatcagatcaaaactttcccatacacgtaaacttccaacttttctatcacatcgtttcatttttaaccatattttcaattttggcgtgaactaaacacacccaaagttataagtatctagattcgtagtactataatatttaacgtccaatactatattattttttttattggacgaagaaagtactcagtatatcatccacacgtcgctctattctcattgacgtgattactccattcgtttcgttctaaaataaacttatttttcacttatcctgtaggtagaaaactaaattatcctcgctttactaaattccaatgcaattgtatcgctttatttgtttccaatgtataacttttccttttttttacaaactatcactatcccgtctcataataagtttattttccatccgttccacatgtatcaaaataaaaaaatgactagtatatttctactttatcaaatccaaatgtaactacttcttactttatcttttagtacaattattctctatttttatgaacttactttgggataaataaaaggagcaataaataaacttaataagaggttgaggaagaggaaatactctacaatgcaataagttattcaaaggaaagcttattttcggataagctcaaggagtaaaaaataaacctgtttatggagaggctaaggctgtatttgcaacccctgttcccaacccctcttatttgttttccacgcgtacgtttttcaaattgctaaacggtgtattttttataaaaaatttctatacaaaagttgtttaaaaaatcaaattaatctattcgtttttcaaatagctaatacttaattaatcacgcactaatggaccgctccgtttttcgtgtggagggaataagttcccattcaccatatgcgaacacagtgtaatgggacatcatcaatgttactataccatcatattgaaccatggcttcaatgatattggtgtcgtgaaaagatctatttttgaaataagttctttttttttctaataaataagttttcacaatggaatagtaaaaggtgaaaaatccagggcaccatcgctggcgatcgatgcgccttgtgcctggctctggttgctgcgactgcgatgctcctgcggcgttggcagatcaggtgatggatggacggctggctggctgacagctccaccgatgatgggctgggccctcgagcgccgcgcgcctccttgacttgaccgtctaccacgaccctccccctcaaccctgaccggtgggtcccacacccacctgtacaacccatgcctgcacagtccacggcactgtaccgtccgttcttccgttggatacaccaaccatcatttgacaagctcgtcgtgtcgttcgttacaccatcatgccgaaattgccaacccattcgtcgtccacgtctactccctccgtctcaagaaaaaaaatatgatatgttctaatacgataaatctggacagatgtatgtcttattttataatactagaatatgtcacattcgatactaggttgattttctttttggaacggagtgagtacgctattcattactttttggatggagtagtacgtactagaactatttttatcataaaatataaataactttgattagatgtattactatcaacccgaatagagtctatctagaggcctatttacatcgtagctaaaataaatcttattaaattttaatatagatggtaatattgttaaaattttgacatgatttcttatttatttactaaatttagcaacaaattaaacgtggatattttttttggcacctttaaaaaaatagtatggttaaaaatggcatcaatctaaatatcccctatattactctaattaagatcttttatattttgaggatggattacaaagaaaatgaagcagccgcaaatggtacacggaagaaaaatgggttgtttatcgggccgtgtaagggccttatcatttgccctatggcttataagacaaagctcaaatttgaattttaaaacttaattttgaacttgattttgatgctttttcaacatagttttttttagctttggcttttcaatcactacgaacatatatgcaaaaattttactcgcatatcattttttaatcgttaataagccattatggtttataataagccattaccaaccgatgggaccataagacatgccgcgtcgtactccgtactagtactcctcccgcaagacgacaagattatacgtgcagcagcaacgggagatcgaagagggcgcaatgtttcgccacgtccgtccttaccatcgtacggccaccatccactcctcgctcctcgttacgattcgtacacctactcgtactccactcgcgaccgcgggtgcaaaatcccggtcataccctcctcactgacaggtttgaccgctagggttaaccgcagaagacgacaaaacgtaaagggtagcgtcgtcttttcaagtcggcccaaatgattgacgtccccgtcctctgtcggccaccgtggcgaaattcatcttcttcccaggaaggatggacggtcggatccgatggcggtttttcttcgcagtgtctcgaccgtccgattgcccgggttcgcgaccgccaaattgtttgtttggcgccaaggttttcccccctcctcccgatttgggatcctttacatcctcacccttcatctcgtgcacaatttcaaccatatccctattcaaataccgattcatcaaaattgattcaggccgtgtttagttctacgctaaaattacaagtttgaacaaattggaacgatgtaacggaaaagttgaaagtttgcgtgtagaaaaattcaacgtgacagaagttaaaagttcgaagaaaaaaagttaaaatctaaacagggcatcacttcaaatatttagtgattgtagtattattttggaaaaggagggggtgaagcgtaaaatggagctgcacggatatccacgagggggggcggcagcgcctcgcgggccgcgcttgtcggtgttaactccggccgccacgtggagcggccgccggtgatcatcgacagctggatctcacgtgccgctcccccctggcgccgatctctctgcaccgtcggatcgtcgccgacggcccggatgcggccccacgcaagcggataagggaaagcctgggtggtgtggtggtgggccgtcacgtgcccctccccaccctcgagtctcggcgtggtcaacgtggggggagccgatcaagtaaattctttacgcccagattaggggtgcttggatgggctaaaattttttagctcatgtcacattggatgtttggacgctaatttagagtattaaacatagattaatagaaaaactaatttcataaatgagagctaatccacgagacgaattttttaagcctaattaacccataattatcaaaagtttactgtagtatcatattgtaaaaattatggcgtaattagactcaaaagattcgtctcgcgaattagtctaatgttatgaaatgggttttataattagtgtatgtttaatactataaattagtgtcaaacatccgatgtgacaaggacttgaataagtttctggaaaccaaacagcttcttagagagccgttaaccagtaaaaaaacgtaattaaaaatgcaattactgcgctaactacaagaaagtgtaaaaaagatgtagtacagatagaaatgtgcataggcttttttttactacacgagtcagagaggggctagtgtacaaaggtggcttttgagcatcaaacgggaggcagtagtcactcacacgctcacacgtgctgtacttaactttgcatgcgatcccatccatccatcacggcggacgtcgccgtcgtggttgtcgccgtcggcggtcgcatccgtccggccaaatgtggcatcttttcacggatcgcccatctcgtcgccgatgtcggcactgttttggctcggcatccatcatggtgttaaaactgtgtggtgtggggtctcaccagactgtgacacatttttcccaccggctaaccacttcacccctgacagggtaaatgctggttaaaaaaacacatcacacactagtaatagtaattatctttcttaagggccctttcatttgtaaaaaaaccatatgaattttgagaggatttcaatcttctaaaaaaattcctatgaagacttttagaacaaaaaattgaatcctataatattctttggatgaaacaattctataaagactttaaaaaaattagtaaaagcttcaacctgttagaaagtttgcttcgagtctatatttctcattcaatttatgctattcaatcaaacaattattactgtgtttttttttgtgttttaccattctttatcttatatttatattactgttaaaataggtgtttctttctattcatttgatccttattattaaccgctgttgaattcagcaaactgattctggtttgtcgtgtcgtgttgataccgtgcagcgtaacgttactctttaccccctgctgctgctgcagcatgtcgcagcaaatatattgtttaatttaatcaatttgcctgcaaagacaacaaccacgccaaaaatttttctgaaacagagatgggagtagtgtaccaccacacagtggcagtggaaccacctaccccctgtcaaaaaaattaaccacggattaactcccccgtttcaccttgcatcccagaaaatccacacgccgacgtggcggcctgtgattggttggctcgacgtgatgggccccgtttgtcagattatttaccgtgcggggttatatataggggaggttttgtttaccacggtgtgctttgctctcttgcctctcctgtctctttctcggatttttctcatcgaatctctccacttcactagccaaaagtacagtaccaccagtgtacttcaccgtttgatgcgcctcgccgccggcaatggcatccgccgtcgctagcaccatgccctcgccgccgccgcccgccgtctcgttcggctggctcgcccccacgcgcgtgtcgccgccaccggcattgccggcggtggcggtggcggcggagcaggctgtgtcgaaggagttcattgattttgagttcagccttggtggatctgcgaccatgttgccggcggatgagctgttcgccgacgggaagttgctcccgctccggccgcatccggtggcggcggagaaggcggtggcgatggaggcggagaaggcggtgccggagctcgtgaaggcggtgcggcctgcggtggcggtggcagcggaggtgttcgacccgtacgtgttctcacccaaggcgccgacgtgctcgagcaggtggagggagctgctccggctgaagaaggtccagacgccgacgaagccgtcggcgtcgacgtccgcatcgccgtcgacggcgacggcggcgacgccgtcgagatcctcgaactcctcggcggccaggtcgctcaagctgctgctgctccagcggaacggcgggcgcgcgtctggcgccgccgcgtcggacctctccgtggcgccgctcctccgcgacagctccgactccgaggcgtccctctccctcgcgtcctcccgcttctcgctctcgtcgtcgtcgtcgtcgtcctgccacgagcacgacgacttcccccgccactccctcgactccgtcgaccccacaccacggccccgcctccgcctcgtccggtctcaaccacagccgcaccctcctgccgccgccgccgccgccgccgccgccgttgccaagcctcgggcggcgatccagagccccgcccggcgccgcccctcgccaccgccgccgcctccgccgcaggtggcctccgtggactcgccgcgcatgaactcgtccggcaagatcgtgttccagggcctggaacgcagctcgagctcgccggcagggagcgtccactcaagcctccggtcgcggtcgcgcgtcatggacaggtcctactccgctggcgtccgcgccgccacccccgtcgtgctcaacgtgccggtctgctcgcgcccggtgttcgggttcttcaaggacaggaaggacgcggcggcgaaggactcgtcggcgtcgcggcctcggtcggcgcttggccggaagacggcgccccacgccggcaatggcggcggcgcatccagagatcttggtactagcaactgacctccgttttgactaagctagaagcattagcaatgtaacctcaattagccagccaagtagtcgtagcatttcctttccaaagaaaaggaaacaacaaaaaaagaacagggtgagaggagaaatttagtttgggatttggagtgaagagaaatttcaaatttggaggagaggatagattgttttgtgaagtcattttgcttgatgttttgggagaggatcctagatatatcagaccaagctaattggcccatccattttgctcattctcatctcatgtaaatccaatctaatcttctttgcaactacattttgcattctgtttctgctttgtactacatttgatctgagctcgaacgaagagaaaaacataaaactattgcacacgctctattcttgcagtaaaaccccaaatgatggtttcatgtgcgtttgacaaaaaagactgatccttttataaaccatggtaacttttcaccttttttacccggcctcgtgggcattagttttactgatgcaaattgatggagatcgatgccggtttaaacagtgggcagatcggagagctgggcgccagctcgtccaccatgtgtgccggtgatcgggcacagtgctgcgccatgtgcggccatctgaattctcgtgtaaattgctcactgtggcagtaaaaaaagagaggaagaaatggaacggatgatgagtgagtgcagggctgctgcgaacagcgaaacttttgtgaaggaaaagggcccattttggagagagcggtggattgctattgctggtctcgctttgctgttttgctgcattgctgctgcctgcagcgacggaggcgctgccaaagttgggtgcccatgtggtctctctgtgtgtgtgtttgagttttttttttttttgctcgtctctttctttggcttcgcagtggcaaagcagcttcttcttttttttttactaggattttcttttcgtgttatcttttctactgctacagttataagtgctgcagccaccattggcctttgcctggttgtttttgttttccctttttttgactcgtgctagtatagctttactaagagcaggtaattataagccagctgcaaacatattttaagaagataaataaggagagagaagggcagcggactatagatttatcgccagctgtagcacggactccaagacgcagtgtgtatgacatgtgagaccacgtattaatagtgtagtatgtttctattgtatgaataagctattagattagctataaatgaattggagccattagttggctatactattaaacttgctctaaaggcccctttaccttcttagtttttgtacaagtttggtccgagtgttacgtgtagattccaacttgacacgaccctagccaacggtaggggtactagactaatagtaggagtaggattttcactgcctcgagcagcagtgaacatttgaccgcagtaaaaaaaagaaagacaaggatcctgagaagagagagagatatgatgtgatgtgatgggcagcgcaggattctgatctgacggctaggattctcgtgcgagtgaattcctgcccctctcccgggaggcacagccccctgcgcctctgccgcaaaatactccctactccaacattattttttggcgccaaataccggttagtttttgtccatgacacgctctaatttggcgcctaatttgcgtgcaaatttctcttttgaattcgatctgatccagcccaggaatggaggcccacgtacatctaggggaaaaagtacaccgaatgtccctcaacttgtcatcgagttacaaaatcgtcccctaaccgcaaaaccgatacaacgcatcctccaacttataaaaccactacaaactaggtccctcggtggttttgaccccggttttatatgacgtgtcggctgagtcagcgtgggacccacgtgggccccacatgtcagaatgcaacatcagcaaggtctctctcccctgccacgtcagcaaggtctgtcttccctctcccttcctctctctaatctctatctcactcttctctctgggcaggccgtccggtggtggggaggaggtccgacggccggccggcaatgcgggagaaggggcgacgcggcggcggtgggccgggagcaggcaggaaccgcggcggtaggcgcaggggcgacggaggatggaggaggacggtcggagcgaagctcaacgatgcgagtcctgtgacgagcagccacttgcgataggggcgacgacgctcgggcattcccagattggcccggcacgactgccgctctgattgagaccagtggaggcggctccggtgtgatttggtggcgagtaaggacggagcgagctctgcctctatgtggcggggctagggtcttctagcgacgaggcggcttagggtgagaagcccgtgggcggctgatggggagaagaggttgttgctgagcttgctcgagcgggcggccgcgggcggcatcatggttgggacttgggggcgcggctaggcgagggagaaggttgttgtcgagcttgtatgctgttagagaaaggagagagaaaatgaaatcatgtagctcgaatttgtatgctgttatttgatagtatctgcaggtatgagtctcgaagttgatgagcattcgatgattaaattttagttgcattgcatcttcaaacagtccccttagttcgtgcttatatgatttatttacagaattgatattgtagtgtttgaatgtattcaggttctgaagagttcctggagcttattaagagtgcgcttctggcagcactagaaggttactgttttgaacgcttgaaacttactgaattattggttgcttgaactgcgaattgtgagcgagtataatttatgttgctcctcagttgtctttttctctatgcaacagctctgattccaggctccctgtttagacagtatgatgtacaaggtccaattccagttgtaaaagatgtttttatccctccagacacagaagaagatgggctgcctgctgcccttgaagatgccatgcctctaatttcatttttggcccctctatgtaagaagtgttacagtttgtttagtcaatttgaacatgtaataatgacaaagataaatttacaagcagatcgacacatgcaaagatcgaattgctgctgcccttgatacattgcgatttacgacatacatcttcgtgggagcgaggtgctgcttctgggcaggaaactgatactgttttacttggtggccgaggttttggagcagccatgtctgctctaactgacgccctcccccgacgtcctgctctgctcccgccgtcgcctcgcccgtgtgaagccgctacacgccgagggcgtcgctgccgctggagccgggtccacgtcccgccgccgtcgaggtctcccacaagccacatccggcggagaggaggcgcccctcctctgcccttttgctgcctgacccaggcgtggtggcctcctcccgtcgcagctgccgccgccggttctcctcctctcccgcctcgtcccgggcgacctcctccccaccccacccgtcggccggcttgcccaaaggagaaaagcgagaaagagaggagaaagggagagagagagatggttgatgacgtggcatcctgacatgtgggtcccacgctaagtcagccgccacgtcggataaaaccgggatcaaaaccactcaaggatctaaagcgaacggttttgtaagttgagcgatgtaatatatctggttttgtggttgagggacgatttgtaactcgatgacaaggtgagggaccttgggtgtactttttcctacatatctaggcctcctcagctagagggcccaattagtttttagttgggccatgcccaattggtctcagttagttgttgttcgttgagaaatgggttgatctctagtagagtaattaatcagctactaggagtagtatactacccgtgaaattttacttaattaatttatttactaaatactctactagagttcaaaggaaacaagaaaacctactaattaaggcagggtggaattggagagaaaggttggaagtttaggactttgttttgtctcttttgttgctgctggatactgtttggaggcctagtgcctagctttatgttttgctgtttggaacatgtattgcgagcttaaatgctcagactatgtaactttggggctgcgtatatcttgtgggaagtagaggtcttttttttttcaaatccattatctaaagaaaaagaaaaccatttgtcagattccatttctcttattattcgtgaaaattttaggttacaaaatactcaagattaattaaaacgcggaccaggccattagttcgaaattgggccggcctgcagccgtgtgctactgatcagtctagcaggccgggggccagccatgatcagaagtaaaaattaggagcataatatgtcatcatctcgcctcaggaaaactaatcatacaagttacagtacgaggccaacattttcttctcggtcgcgttcaaagaatcagtctaaaaattccaagttgccggatgcatctaaaaatctgtcatgttcttggtcctctcgcggctttctcccattggttcttgtagatcggcgtcatcgcggtgaactaatcaaaatatacgacctgccagttgtacgtacgttcctctgtcatcttctcttcacagtgaagatattaattgtacctgccatctaattaagaaaaaaaataattataagaaaaggaaacctcaccaattatcaatgtccgaggaaacctcaccagtagtattagcaaggaatttcgtgtaatataatagcataaaactgatcaacaagtcacatgtttggtttctgactagttttctagcactggtttcacggtcgtgttcgtgtataacatgctaagcttagctatctgcgccctccaatccaccaggtcaacgtacacgcccaaatccgcaagtgaagagccatatcctagctccggccgccgtcccatggcttcgccgccgccgggggcactatgatctatggcaatatgcacagacagatcgagctgggagagctcatctttttagcctcaggtagcagagctctcttcgtttgttctctctctgcatgcagtatatactatgttcctagctagctaccacgatctatatatgtatgtgtgaatatatagttgttgattaggctaagacagagatcaggtaacaaaggttgatggtattgattgctatctttaattaattcatgtgctaattgtgatttccttctctcaggttgattaggctcaggtgcagagacagcttgtagatagctcgaatgatatgacgacgtatatatgcatgaagaagaacatcaggatcaaggaagctacctttatttgagcttcggaaaaggcagttgatattttggtacatggagatgaatgattagagccaagtgaatggtccaagcacttgctaaattcagtacatacccctctgcatgccttaattttgtggatctctcgctcgatcagcgacgtcggtcgtcatctcgtcacaacatgggattgattggtgagtggttaatattttagttattactaatacagtactctcccttttgctctatcttttcgctgtttttgctattcgtctttttatgaggatgtgtttggataatgggaaatgaggggtgggattaggattggaaaatgaatgaagggttagaattaaatggatgagggagaatgaatagttaggatttaaagataggtgggaaatcatttccctggacatttgccaaacactgcctgaatggtttggtagtttgatctcctcggagctgagacttgtgtgtcgatgttgtttctttgacttgtgactctcattggattttcttcccagttcgggcccatcctaatagagatggtgaaagcccatatttgagcccatttgaaccgagtttgttatttgggctgatgttgggccgtagcccagtttcaatgggcccgcatgaggtgtgctatagtacggcgagcataataatcaccaagttcatttcatctagccgaaagccatgagggtaaataaaaagatcgtcgtcacattttacgaggatcaaatttaccgtttgtgcgtaagaactgcatgagcagcggtaaatttagcaatttccaagtgctttcgagctccgatcgcttttccccttcattttaatcgcgcgagatcaagatcgatcgaaaccctagctgaccaagcggatcgccggatcgaacccgcaaaacgcgcgcgcgccaccactacgacgccatggaaggcggcggcgaccactacgacggcgggcacctgccggagctcggcggcggcgcgccgttcttgttccgcagccgcaccatcggggtgggcgccatcttcctcatgtggggggcctccgccatcgtcctcggggccgtccccgagcccgccatccccatcgcccacatgctgctctccttcgccttcctcatggcgggcgtcgcgctgctcaccctctccgtcgctgccccccgctgcgccatggcggcgagggcggcggcgaccctggagaactggctcacggcgttgatctagggttggctcgatccgattagatcagatcgcgttgatgagtagctagcccaactaattaagccatatatgcatctctcgctcctcgatcgattcgagtagcttattatggagtgtagcagttaattaattaagtataaactgtttgtgttgttatgcaactagctatagcttgatgtgtgatgatctaattgtaaatttgtaattaaagagatgaatgttttttttaattttctgttgttaatgtactgtgcatgcagctgcttgatagatgtataatttatactatatgtattgttttgtggtgtataaatatatatattaagcttgagagtgagttgccaatcttcaatattggttgcattgtcataaaatttagtactgtctatatatacttcatgtcaacttcttaaattttcagtagtattttttattatattgatatagtttcaattctttgcagtcaaaacatgcatgaattgtttaggtatgccggccacattagtttcatgggacaaacgaagattgcgaggtataacaatccggatatttatacggttatcagatagtacaaacaagtatgactgatatttgcaattggactacctgatacaattgccatgagatgaatcttcaaaagcaaacatatgtcttgaatgtccggctgggtactgtgtggatatgtaaatatatagaagcatgatcagttgattacatgcataatgatcagagagagatgaagctggcttgcataagtacactacagatcaagagcagggaatttttcgtttttttcctggttacgacctttcagggttgtaatcttatactctatcaatagaacttcgttaaaaaaaagagcagggaattaacaaatgcatgagaacgcagcatggtggaaagcacacgatgctggtgagtatgcaaatgtacattttaatgccccttatttgttgcattgcttaattcctagttttagccagttttgccaatgcacggtgtaagttttaagagtaaattgcacccggttatttaattagcatagaatttcactttgcacccggttattaccacagttgtagtgtgagcatcttaccattaacagaggcagtactatgaggacatgcagttgattaggctgcaacatgttgatatatatcaatggtatggctagctagtttctgtaacacatagggcatcccactatctgtaattctgtatgcaatactgaactatatgctatgctagcttgtaggacattatatttggcggaacaattgggaagtgtctgtttagtccaataatggctttaattagcacaatattgtcctttgggggtgaatatgtattctgattatctttggagattttacagttgaagtgataaaatgaaggatgcattatgcataggcataaattcatagccccagctgcctcaattcactaactaatacagaacgtttaggtgtacaatcatccatttctcatcagccctctttcatggtgtttatatatgtgtgtgttgcacgtgctcagtttatggatgatctagcaacagctaaaatgatactacggattaatattgctttcctatctgaaacaaatagatcaggcaatacacacatcaatcgaggagtcctaatacattaattgttttatgatgtttatatatgtgtggggaaacatttagctatttaggcgtctatatatatactccacgtataaatatgcaatgtcaaatataacttctacaagttgcaacgaaaaaaaaataaatttagctataaatatacgttaactaaccatagtttaatttgttttttctgttgtaacttgtagaagttaaatcttaacttgtatgtttgtggaatgatttatcatgtatactaatctatcttgtttttttaaatttttttcataaccatttggatgacatgcaaataacaaaatatatcctctcaagagtttagaatctattccgcttgtgtgtcatacattaattgtattgtttatgctctacttcctcattgcgggagtcaccagcgtcgtcgccggagctcccgaccggaggactggaagggtgtcattcattgatctccctcttaaaacaataatgctaactttgaagtttctaatcatcaacctacaatctgtctacctatgctaaggctgtgtttgcaaccccttctttccaacccctctcattcgttttccacgcgcacgcttttcaaactgctaaacgatgtgtttttttaaaaaagtttctatatgaaagttgtttaaaaaaatcaaattaatctatttttgaaaaaaaaatctaatacttaattaatcacacactaatggaccgcttcgttttccgtgcagagagtacaagttgccatctggggcatgcgaacacagcctaagctattcttcgctaatttgctcaacaattttcaggaagtttttttagcacgtaccatggatttaatggtttctccttatactacatatgtgtattgtgaagaattattgtgtatgtgtgttacgcccagaaattcactagtaatttccgaactaatttgtgcataaaatcttcgtccaggaatcagccgaggtacacaaactgacaatttaatatacaaatccatcgtaataataacgttacatacttacaaaccaaaagaaaaacagcagcggaataacggtctagcgatggcttcagctccactcacacaggcagctcaactggggtataagccaaacgacttctccttctggatcctttttcttcaactgaggttgattgattattgcaaggtgagcatatgacatactcaacaagccacacagcaaatatgcaagtgtacaaggataccaaaggatggcataacataggctcatttgcaaaagcagccgcaaacacttaagaatagtaaaacagtagagtaatcatcaattttaatcaacactgaacagcacacccatgctgctcaagcccaaccatcctgaacaactaaacctggctacacatatctaattccaaaccaggagctaagcaaattattaccaattatagcatcaaaaattattgtgagaggtgtgagactaatcacgaaaaacattgctcaacccgcccatgactacgggctattcgaatagttttactctggccagagatgtaccactgtacccacaagacacaattccacacatgttaccatgccccgaagtaccaccacggcactgcaaagggaaaaatcgtgacaatacccttcgcacaacacaactcaccacagtgcaccattcctggatcataatcaccccctcaaaaaccagaggcatggactccccagcaacccccacggacttctcgccgcttctcattctggcaccccgtaatgaaccatgctatacaaaaggtaaaatcgttgcccacgctggcttgtggttgacacggttaatgtctcacaacagtagctcgtgaaccggtccttaattgtcatgagcacgaccttcaaaaccatgtgctcacaacccatcattgacaagttttaattatcaattaattatcataacatgattaaccatcgtgagctaccattaaatataaccataaataataatgtagtatatatgattcatcccattaatgagcttatctttctaagcatggctaagcaattacatgtgtagcatttagctgaaccaaaccaatatataaggttctagctaaacaaattataacccatagaaaaataaagtcatcttcggccattaattaattgagaaaggctcaccacccgatgacattcgaaaataatgcataagttgaaataaaacattagctttaaacgggttcaacatgctcaaatggttgtttgggatatgtgtgacttgccttgcaataatcggtcttcaattagtcttcttgaacacttccgacgtactcacgaaccttcgcaacaacggatacgacaagctaacacgcaaaacaaagaaaaagactaataaaaaccaaataaatagtacataaaaagtagacaaacatgtagatcataattttagatgaatttagagacttgaaccacttaattccgacttcatatgaattagttatgaattttagaagattaattccaattacaacctattaaagaaaagactattccaaattaattaaataatttacaaataatttatatctgagataaaagactaaagcatcttccggaaattattgcaatgaatttagtagacgacatatagtaaaaagaactaatatgccattgaaaagggataacaggatttatattgattttgatggccgagatggcgctgatgtcagcgatgacatggctgccacgcgggatcgacacggcgagcacgagaacggtggttaccagcgaaccacggtacaatgatgcaaacggagggcaccgggagagagagaggagatcaaggcgacccttaccaccacttccacgacgacagacggcgagggagatggccggtgacgagctccgcagggcggcgaccttgggttgacgatggcgatggctttccggcgacgagcggcggcaacggaggggtggacgggcttctcctcggtgcttcgaatccaatggaggcgacggcgaccgaaggcgaccatagacgacgacgaacggcgcggctggagatcaaacaggggtggcgaactcggccttcacggtgacagcggcttccggcgggatttggcggaggggaaccagtggacggggtatagctcgaccttgcggagccgagggaggtggcggcgcaggagggcgacggccgaggcgacggcaaacggcggctggagcgactgccggcgacggagagagaagacgagcgtggggaggcggctagggttagggaaaacttcgggaaacagggggaaaccgaagaggaggccgaggggatgctatttatagccggaagagggagatatcgcctcgggaacagatggatttggtgaaggaaattaggatttatctcgagttcacccgaataaaaacggccaaaattcgtgagatagataacgaatttgatggggatttcttgtggataagatagaggagatagagaggaatccttttttgcaatcaatgttggaagggaagcaacaaagcgaccggattcggcggagattggcgccggtatcgggatgaacacggcctctgtccagccggctggaggtaggagaagcactgtagcgagagggagaaggattagactttacgctgggctgaggaacagagagaaggaggaaggaatgggccgaaaagggcccaagctgaggaggaggatttttattactttaacaaataaatcaatcaccaaaatgatctttgaattgttaaaattacttccaatgctcaaataatttcaggaaaaaaatcctgaaactaattggacactcaaagtacttaacaagattataatcagaccatttaaggattaatttattatttaaataattgctgaactgctctttgtatgattaaaattaggaattgagctccaaaaaatccgagaaaattccagagagtataattaaccatggagaatttaataaaaattaaatccatccatgctttatatttaggaaattttatttcccacatttaacttcacttgtaaattaataaacatttaatataaattccaataataatttattaaataatttataaatcctaagacgaaaatcaggatgtgacaatgtgtatgcaggtgcggatctaccatgagatggcggggctcgagcctctactgttagcgctaggatcatgagaagtaccacacgaaggcttcactaaaacttttttgccatacatatatgagaagaggggttatagttttctccagcttgtttagatatccgtgttattttttcatgtatctaccaccgtgtgcatgaatacattttggtgctcctacctagtatatatggccagatcagaccatgcatacaattaataatcatgcatacaattgacttcgatctgatccagcccagcaacggaggtccacgtacatctagacctcctcagctagagggcccaattggtttttagttgggccgagcccaattggtctttagttggaccgggtccaattggcgtttattgaagcttagcgctaggcctaattacacaggattacactgagaagttagctcaaaccatcgaattaacgcaaaccaaattaactagagtactaaactctgttcgtaatcggagtagttagcagcatagaatcatagagacggcgaattgatccggtttcatgggtaattaattagtcccggccggacggcggcgacggcgggttgggcggctgcagcagcggcaggttggggaagttccagccggcggccatccccggcaccggcaccggcagcgtcgggaactgtaccgggatcggcggcagctggaagctcggtagcgtccctgttggatagtactccctccttccctaaatccctaaatgtttgacaccgttgacttttttaaacatgtttggccgttcgttttattcaaaaaaacttttgtgatatgtgtaaaactatatgtatacataaaaatatatttaacaataaatcaaatcaatgatagaaaagaattaataattacttaattttttttataagacgaacggtcaaacattttttaaaaagttaacggcgtcaaacattttgagatggaggtagtgtaagagatgtatactacgtaacgtgggacacattgtattgagcctcgggggccggtatatataggagtacatggagagaagataaggaaggattacagatatggaaggagtccacataaatcaatcatattctaatatgactctaactaccatatactctaaccgtcctcatcccaccaccggccgtcgccgacctcggcatccccagctgcggcgcggccggcggcgatgtcgatccctcggccgctgcagcagcggcggtgtggctcgccgcgacggcgcatgagaggagcagcaacgttgctgctgctgctgccggcgccgtgcccttgcgcgccatctgtgtatatactgaacgtcgtcggtattgtgttgcaagatttggtttgcttggatctctctgatagtctgaacgtattatatagacacacacaccaccacagtttgcagttgcagacaggaagtagtgtcgatggttttggcaggagacttgtgaagtttgtgtgatcatgtgacggatcatatcgatcgacgcatgcatgcatgaatgcaatcaacatagctactaccagtgttccggccggtctcgtggttgtgttgtttgcgtggtctcggttagttgttgttcgttgaggaaagggttgatcagtgcagtaattagtgatcgtgacaccgcaaattaaatacatggcgagaccgccaaattgctatatgaccatttgaaattttactttatttgctaaatgtacaaaggaaactccaaaataatttgtcagtgatatactccctccatcctaaaatgtttgacgccgttgactttttttaaatgtttgaccgcttgtcttattcaaaaaatttaagtaattattaattctttttctatcatttgatttattgttaaatatatttttatatatacatatagttttacacatttcacaaaagtttttgaataagacgaacggtcaaacatgtttaaaaaagtcaacgacatcaaatatttaggaaaggagggagtaccaaaataaactgttttaggctagaattttcaagattaaaatacggaccatccgaagtacgttgggccggcctcttagctgccccgtagatcagcgtagctagctggccgggccagccaagatcagtacaaattaaattaggaacatgtcattgtcctctagtctcaggacaaaaatcacagtataaaaaccaacattttcacccgtaccgttcaaacaatttgtcttcgatttgaagttgccgtagtctaccttgcattcaccaaattaaaactgtcctgttcttcgtcgtcgcgctccctcaccctattggtcgtttcagatcgcgtcatcgcgacgagccattcaatatacagacctgggtggtgttggagcgttcacccgtcactacgttctcttcgatatatactctaagaaaaaaaataatctgtacctctcatgtactagtaatagtatcaattaaataaaagcaaccacctattaaataatgtttgatgctccagctggagcacgatcgatgatctgattgaacggtctagctagaaatccgtgttgtaaaacataacctgtttatattggtttcaagctagtttttccaatccttctatgctacttcctccgtttcataatacaagtcattctagcatttttcacatttatgttgatgttaatgaatctaaatagatatatatgtctatattcttaacatcaatatgaatgtgagaaatattagaatgacttacattatgaaacggagggagtaggaccttgcttgaggaagacatgttactacagtttgcctacagtttgtgctatatatactggcctctatccaggtcaacgtgtctaacctgcaagagagctaatctcctatatggtcttagctaccgggatctataccctgcaactgtcatcagctgggcatgaagaacagcaggcggccagctatatttatttcagcttaattctcaaagggtatatatactttggtgaagatcgatcggtgcatggttgattagagagccaactgaatgggatttcgctcagtttgatcctcatcacagtaggtgcttaattggtgagtggttaattagttaatataagcccctcctgaccttcttttggctctctcttttcgacgctttttatttatttatttttgttcttgatggatgattatttgatctcccacgatctaagattgctgttatttactgtatttgagttctgaccactgctcccacctactcaaatctaatagaggccattgcaaactgcagtgtcccctctaaaatggcccatgatattagaaagcctcttgtaaatagtacaaacaacatgaaacaagcatgagctgatatttgcaattgaattttctatgagatcgatgagaatatgcaaaagcaaacatataggagcatatgtccggtcgtgtaccggccgtatggatatactacctccatcccaaaatatttgacgccgttgactttttaaaaaatgtttgaccgttcgtcttatttaaaaaatttaagtaattgttaattctttttctatcatttaatttattgttaaatatacttttatgtatacatatagttttacacatatcacaaaagtttttgaataaaatgaacggtcaaacatgtttaaaaaagtcaacggtgtcaaacatttagggaaggagggagtatatatgtaaacagaagcatggttcctacatgcatattgatcagagatatatactctctccatcgtcttataaaaaacaaacctattatgagatatacatcataatactacgaatctgaacatgagcagtttgtttttcatgggatgaaggagggagtatgaaaagctggcttgcttaattgtgcaccatgcagatcaagagcagggaatgcaagaaaatgcagcatatggtatgtaaaatgcacgatgctggtgagtaatgttttaatgccccttatttgttactttggttaattaatttctacttaattttatccagttttgcctgatcagtaccctactttaattgtttcactatataatttgcacccggttattactatattgttgtagtgtgtctatcttaccattaataagatactccctccgtccctaaatatttgacgccgttgacttttttaaacatatttgacctttcatcttattcaaaaaatttaagtaattattaattccttttctatcatttgatttattgttaaatatacttttatgtatacatatagttttacatattttataaaagtttttgaataaaacgaacggtcaaatatgttttaaaaagtcaacggcgtcaaacatttagggacggagggagtaagaagtataaggctagtttttgtaacatatatagggtatccactatatatccctctattcctttgcaatagtactgaactgctatgcttatactaggacattaattactttggttacacagttgggaggtgtcagtttagtccagtggctgtagcacaatgttgtcttttgaggtgatttttttcatcaagtttattttgcatgatactccctgatcattaagatttcttagcaacatttatgaaaccacattaaaaaaaggacgtacgcataggcagatatatagcccgtgcttcacttgaagatttgtcattcatgcctcaattttcactagctaacacagaacgtttatgtgtacaataatccatctctcttttatggtttttatgtgtgtgaccacgttcttactagatgcacgaaaattatcattttagagttttacagtttatggaatgcttgtgtgtgtgtgttgcaaatgctcagtttatggatgatctagcaacagctaaaatgatgctacggattaatattattgtttttctatctgaaacaaatagatcatcaggcaatacacacatcaattgaggaacaacagctagcacacaacttatttcatgaccacgttcttaattagtttcttactagatgcatgaaaaccatcattttagagttttacactttatgaaatgcatgacagatttcaatcctagtgatagtagaaaattttcaaataagctagctggtgcaaaatggtttctgcggccgctatgcatgtcattcccattccccagaagttgatattgttaactgttaggtgcaaacgttgcaagcaaagcgcgcatgacacacacagccagagggcttcatgcatgttattaattacgatggaacaaattactccgatcccattttagcgcatgaaaagatggtttttgctaaccagccatcttaaaatggattcatttgcaattgaacagtataaatttacatattaattgtattgttttatgctctacttccttctcacggcgagagtcctgctactatactgctggtcagtcggaccgagccatgatccggaagaccggaagggagtcattcatgatctccctcttaaaacaattaataaggctagcttgaagcttctgatcattaattaacctacgatccgtctagctatactaagctactcttcgctaatctgcttaacaactttcaggaagtttttttcaagtatgtactatggattgaatggctgcttatacatatgtactgtgaagaattaccgtgtatatgtatgcaggggcagatatactttgggggtggcgggggctcaagcctctactgttagtaccaggactatgagagttctacgaaacctccactaaattttttattttgccatacgtatatgagaagagggttatagttttatttaattagtttgttcagattccttgttattttttcatggatctaccaccgtgtttatgaataaattttggtactcctacctattatggccagatcagaccatgcatataattaatcagtaattgttgctgtggattttggatcggatgagtgtgttaaatcggctgtactgtacgttgctgttgttactgctgatacacggaacctgcaaatgagcataggaaaagattgtttgcctatgtatgtatatatgcattttaggcgccaatgtattcggtgttgttaactaatctgtcgacgttttaattatgaatggcagaagtagctagtgtgcctcagctccgttgcctatctggaatgtgagaaggttgttcctaataacaaacgtagcaagatataccgatgcatgaaatgtaaatatttattgaaaaccacaaattaaaaacattcttaggttatatcgtcgactccgttgctgttactttcaccattttattggagaacaacttattatagttaccttggagtctttggaccggtaaaaatacaataggagcgctaatttgccgcgttagtttcctgcaaatatttctttgggcgtatatagatcgatctgatcgagcctttccgttttcctttttggacagtgatctccaatttttctccaatctagcgggctcgatctgggtagtttagttgggccggccagtaaaaacggtgagattctatttggccttttaatggaaaagttcacttttagtccctccagtaatgcctgattcgtaatcctcaggaacaaaacaaaatactccctccatcccaaaatgtttgacgccgttgactttttaaaaaatatttaaccattcgtcttattcaaaaaatttaagtaattattaattcttttcctatcatttgatctattgttaaatatatttttatgtatacatatagttttacatatttctcaaaagtttttgaataagacgaacggttaaatatgtttaataaagtcaacagcgtcaaacatttaatgaaggagggagtataaagacttccttatctatgaaattaccttgcctctctaaccgatttggacaacggtggtttggtcctctctctcatcgttcgatcttatgataaattttctctcctagtcgacgtgttatataggaccaaaccatcaaaaaggtggttcttggaaattttctcataagaacaatgagctagagtctataaagaaacagcttcgagaaacgtccaggagtcctccgactagcaccacatgagtagttggctagccggcctaggttccatcctttctaataaaattcgatgtgagagccatcctctcatacccaacgtttgtcttaataaagaaacagcttcaagacggtgaagcgaggaacaattaggctgagcagcagaatggtgttgtggttgagcgtttatccaacaaagagggatacagatactaatcatctataggttactccctccaaataatttataatttctttgtggcactcatataacatgaagaatactagcgcttacatgacattacaataataaaataaatagtgttaaaaatctatagaacctacatctaatctcttagaggttggacctatatgccagcatcatccatgaggggttccaacacgaaggtgtacgttgggctggcagcgatcgacgatgcagaggcgaaaatatatttataattgtagcactactttgtaacaagtagacaattttcccgtacaattttgcacagggcttgttgacttagatttttttatagacaactattgtctcctatttctatgtatattttttcctatatatacgcattttggagagtatgattgatttgatatatagctcataacttttgttcctatagatatgtacaaatataataataacttttatagtacaacaactattagttaatataaatttgattgcatatcttgatcaaacaatctagattttattcgttttcttcaattattgtgataacatcttctagaagatggatatacgggttttctttaatttcgagctatcatgtacacaaagaagatgggatatattgtaggtgttagggttgtctattggatcacctaggtttagatctagtcgggtggttctatttgtgatggatgattgaacaacaatagagaataagggaaagggtttagggatgtgaccggttgacgcgttggatgaagaggaagtcccggccatcgtcgccgccgccactccaccccataaaccctaaccgatcgagggggcgcagccagtgacgggaagactccaccgccacgccacgacctcgccgggatcccctacgaccaccactgcggcgcagcaccgtcgccgtcacgaccaccatagccgccgccgcccacgtcaagcagagcgacgacaacgacgatggccgggacttcctcttcatccaacgcgtcaaccggtcacatccctaaaccctttcccttattctctattgttgttcaatcatccatcgcaaatagaaccacccgactagatctaaacctaggtgatccaatagacaaccctaacaatggtatcagagctgccctagtgtttagattggttcgggaaagaaatccaaagagaaaagcaaagaaaagcaaacgatccaacggatcgaaaagaaaaaccctaaccctaatcttacctcgtcgccggccgtcgttgacgccggcaacggaggggggaggggcaaagaggcaccgcctaggagcaactcgacggccgtgcgcgcacccgcgggtgcacgcgcgcaccggcgaggaggcccgcggcggcgccgccatctccttcggccgccaccctctttctctcatttcgcggtgggggctagagacagtggggggagaagagaagagaaaagaaaagatggcgccgccgtgtttccccatccaccgccgtcgccggccgtcgccgaagccggggggagacgagagggcgccgaccacaccgttgcaaggccgctcgacggcggcgcgctctgcctagggtgagcacgcgcgccggcgaggggccccgcgacggcgccgccacctcctccagccgccgccgatggcaccgccgctccggtgtagagagaggagggagagaggagaagtgaaatgtgcggctagggttcggccggtcgggaggaaggtttttttgtttccccgaactcggcggctgaccgtccgatcctaaccctagcaaatggatggccggatggtgacggtcggctggtggccgcgggccggacgggccaggccggccaaaagtccactttaggtccctcagccgaaagaaagaaggaaaagaagaaaaagaagtttaataaaagtacctcggccgaaggaagcattttcaatatgtttaatggttgtgtttatttctaagcaatttgaaccaacgtgaaaattgtttagagaatagataaatgtgagaaatgcttctgaacatgtattttgtatattttcatgcaaattacaatagaattttgaattgtttttgcatgttttacctctgtttaaatttgaaccaacgggagaattttacagagagtaagtaacagagttttgttattgtttatacgaattgtatatagatcttccgctgcaaatagatctaaaattaaatttcgaaccaacgggagattttaattttaggaacattaattatgtgctatgatgttgtaatttttctgaccaacgttgataattgcaatgttatagttatggctttatgtgttatgacgcaatcaatatgacgcaacgaaaattcgggaacaaacagatcgaaaatctattttatactcctaattactatttcgcttggaaaatttaaaaatctctaacaataataatctaacacacttttttttgttgtgtttgtatgttagttgcctgcattagatatcttgacaataccactcgcggcgccaaacttttcgagcacatcgtcttcccacaccaccatcgcctccaccatcgccggatcgctcgaagggtagtcgagcagcatcaccgccaacctcgccggagcatcctcctcctcctccggcggcggcggcggcggcagccggaacacccaggcgaccaccgtgtggccggccctgaggccgttggcggcgacgaacctgccgaagctcttgagccggtacaggccattgccgttcttgccgtccacgctgcccaccctgccgaacctcatcgccccgtacctccggccatggcggtcgtagccgtcgagcttcaggccggagctcttcttcttcttcttcttggagaggtcgtcgtcgtcgccgtcgccgccgtggatgagcctcttctcgccgtcggtgaggtcgccgctctcgacgaggccgcgcgcgagctggtacgtcagctgcagccgcgactggttcggcttcgcgtccgacgcgtccacctgcttccggagcttgcacacgaggttccccatgcccagctgctgcagcatgatcaccatctggtctcgcggatcagtcggcggcggcgcaggaacggcggcggcgatggcgtggtcggcgggcggcggcgccgccgcggcgccgttctgggcctcggccatcgctagctccgcacgcttctccaatggtttatatttttttttattttgtttctggtgagattttatagaagggtttagggtaattatctctcggtttaaaatttcttattacagatatggggagataaattctgctgttgttcctgggcgttggatcttgatccaacggcggcggttgttaccgaagatatagaatgtaaacggtggttaaaaactgacagctcgaggtaaaattggcaatagattaattttgcatcacttaaggtatgaagtacgacatttcctgcctacgtactaactgggccacacagcccactgcctgtcgccatcacgttccagcccaactagttgggccgcacgtctgtcacgatcccattccggcccaagacgtacggccctcacgtgcatcatactccctctgtccaaataagttcatttttcacccattccaaacatagcaatacgaaatcaataagactataatatcctcattttattaaatctcaatacgactatttcttactttatctattctcaataaagtcattccttattttcacaaagtccaatacaataattactcataaatgaacttattttgggcaaacgaaagaggctaaaaatgaatttattctagaactgatggtgtagattttagatgcggtgtgtataaaaagctaagttgcgaaattgcgagctgtaaggtgttgtaaccctaaatgtaaaatagttgcaaagtaaccgtaactcgaccgattaggtttcttgtagtaaaactagcccacatgagttttaagatatgggtgctcacatttatgattaattattattttagtgatatgcgacgtatccatcaacagcgagatacccatagtgactttgctaattttaagatatattggtttagtcttttgaatgtgttcataaggataacgtatacgtgtgttcatagggatagcatcgtacgttgtgaacatttacatccgtactgtgtttttaataaaaatgtaaaatagctactggtctactccctccgtcccataatatagcaattgctatattatgggacggagggagtagttttcccagataatcattaccgtgtctacaagggcaacagacaaaatgatttgaagaacaccaatgggatgactgaggtggtgaaagaagcacaaaataagctaggcctacagcgttgaccattgaccaccgagttgacgcacgtgttcgtcaaccattaaatcgactcactgcctaagctaagtcagtcatctcctatatttgttcagtttgcttcagcttgcttcctttagtttaaaatggcaatgtgatcgatcgagctggtggatctcagctcgtgggctttactgccttcgcttcgattcaatttccaatggcaatgtcgacgaccgccatggctggtgatggccatggagtcgaggtcgacgacgtggaggtcggccggagttgcgtcgcggtggcgccgccgccgccgccggccgaagaggaggagaagaaggagggtgctgtggggacgacgtcgtcgacggcatcagcgctcgccgtcgccgccgcggccgccgtcgagctgaccaacctcttcttcttcctccacggcaccggcgacggccgggcagtggcaccgcggcggcgagggcggcggcggtgctgcgagatgggcgtcgctcctgtggagcttgttgaggcggccaccgtgatcttggctctcgccgccttcctttcggccgccggcctcctgctcctccggcacgcggccggtgatcttggtgggcaccaccggatcgtctctccggcgtgcagcacggccgtcctggttgcttccacggcggcgctcttcctcgcgtcgctcggcaccgtcgtcttgctgctgaacgattatcaaactgtcatgtactaatctgttgccgctaaagaaaaaaaattggagggagaaattaacaatgtcaccccaaacatttttttaagcggaaattataatcgtgttagagattgaacacgtgagctcaaagttgataccacacactcaattaccactgccctagtaagtgcatcacatctatcgccgttgtacatgaacaacattacaacaatgatattattaagagtaaatttcacaaaactatatgttttatggttcaagttgcagaaaaccataaatattttgacacttggcatttaagtacatatgtttttttggtaatttcacactatcgatgaatggattcacccgtgagatgacgtggtcgttccatctaagatgaggacgtggcatcctattaatttcgtgcgatggctggtaataggatgacatgtcctcgtcctagatgaaacaatcacgtcatctcgcgggtgaattcattcattgatagtgtggttttgcgaaactacactatcaaaatatatgtacttaagtgccaagtgtcaaagtgtgtggttttctgtaacttggactacaaaacgtgtagttttgtgaaattcactctattattaattaagagagagaaattaacaaattaacgtctctccaaatattttttaagtagaaattatgattgtgttagagattgaacacgtaagctcagggttgataccacacactcaattaccactgcactattaagtgcatctcatgtattgccgctgtacatgagcaacaatgatgttattaatagcctacaaaattcactcacctcggcgttgtcttttttacaagatggatttggtgaaatttgatgggaaagcaaatatgaagaccttgtcgatcggttcgtggccaccaaaggtgaacgaagcatggagtggtgtttgcttgagatggaggtcgcacatttggtggtgaccttaattcgtgcgtgtaggcgtcgatagcgacgacgggaacgacaacagggtgtggagtctgtggcaacgaaatcctcatcggatcggcttcagcgactttggtcatttggtgcgtggtgacaagatctctgatttagagcttagttactctccgatgttatcttccgttttggatcgacgtaagtcgcagatgatggtgtgagcgaaattcaatcggtataatgatctgccgctgattttaatttttaaacatgaagttttctcgtttgagtaagattatgactgcatagaatttataagctgctgatcaggaaaacaatgtttatgtgattctcgctagtatctttgtcttaaggtgaatattctaagtatttttttcttaattaagctatgattttgtaattcacggttatttgaccttttacctatgtgataatttgttatagtttctatgaagtaaaaagtccgaagaaaaaataaatttgatctctagaaaacaaaatggaacctgggcacacgctgcactcaatttcacatttcacctgtcgaacccaacaagagcccacctatccaagggccaaattgcaggccgcagtcacacaaaacaagcccagaacccattttattaaatgccagccaaggaaattggccataattaattcaacctttttgggggagaatgattaactcatccttaatactgtagtggtcactggtcagtcaacatatttttctcagggaaacagtcaacacattgttttctacacgaagggtaggtctcaattgcattagaggaggattttttttttcaaaaaaatgtttacagcaggcaggaagaagggagcagtacagaaaagcgaaaaactcgtgcaaattacactaaaaaagtcgctccctttttaaaatgtccccttaacttgcgatgtattgtggctggaggttttggtctcgaaaagttcaaatgcttatggccatttagttcgcgaaaagaaaatttttcagtgtcacatcagatgtttgatcggatgtcagaagggtttttcggatacgaatgaaaaaaataatttcataactcgtctggaaaccgcgagacaaatcttttgaccctaattaatccgtcattagcacatgaaggttactatagcacttatggctaatcatggactaattaggctcaaaagatttgtctcgcgatttcctccctaactgtgcaattagttttttcatttatctatatttaatgctttatacatgtgtccaaagattcgatgtgatatttttgggaaaaaaatttggagaactaaatagggccttaaacatgtgtaaataactaggcaatttgacctatgctcatttttcatacaaccaaatacgcatacgtaacaacggattatccaaaacagaaaaaaatatttctcccagtcctaattgagaaaagaaatctcaatctggttcgaacaagattctccatcttaaaaaggaaaaaaaaaagacaaactgctgttaaagtggtaagttagtataacggtggtggtattaccatcatcactaaagttaagattttgctgtcaccatgatggtacaaacacaattagcaaagaagcaatatgtgcatcaccgttttaaaaacaagatcctaaaaggtccgacaaaattggttaaaaacgattgcatgtctacatggcccatttaattgtgtaatctctgcaactaacatattgcttttgtgtgttgatgtcgaactaagacctcggcacacattatgttgttgtttgttttgtagtatgcaatttccttgcaaacaaacaacccttttttgttaccatcaagtcaaggggacatcagtagtagtgtaatccatacaatgacgttgcgacaaattaaagagcgagttggaaaaagggaaagctcaggcctcagggtgccgcacttttccaccggaaaaaggttaaaaacgattgcatgtctacatggcccatttttgtgtaatctttgcaactaacatattgcttttgtgtattgatgtcgatagggatgaaactggttcgaatagtttccgtccgtccggaccatttttcggattcggatagtttcggtcggaattatccggaaattctcggattcggaaacgaattcggatattttttctcggaaacgaaaacgaatacagtaagggtattatccgtcagaatcggaaaacggtcggaaactatccggaatttttttcgaatatccgtagacattgagcaaattttagaataaacacgtatatatgcataacttttttatacggaatcagatgaagacaaactttatatcaatattgtagagcttgatgagatctacagctttattattgactattttattatttgaggccatttaagggtctaaatattcattataatataccatattaatttttacaaaatctcagatctacaattcaaaagacatccgatggagatgtgttccatatcaaaattgtagagctcaacgggatctaccactttgtagtttataacatttgtatttaaaagcatttaaagtataatacaaacattacaagtttcgaagatgtgaagtaaaataaataacatctccaatttaaacaatagtaagtaagttatacatctagtaaaaggtcttgggaatagaaaatgataattatatttgcatatggatctgttagaggaacagccatgaaaatcaatttttacatatagttgtgggaccgtctacaaaattgacgatataaatgttggagatgttgaactaaaataataagcgatatctcttcctttatcaaaaaaactcaatttgaggggttttttatataccggtaaatattcgctaccgtattcgttccgtctcgtattcgctccgtatctgtattcgataatatttgatttcatttccgtatccgagtttttgattccgattccgattccgaaaaaaaatatgaaaatgaatataataaagctagtttccgatccgttttcatccctagatgtcgaagacccttggcatacactatatgctgttgtttttgtatgcactatacatatatatatatatatatatatatatatatatatatatatatatatatatatatatatatataggacactcatatggggcaccatggtgcccgggcaccatggtttcaaatgcacaaaatcactcaaatttttcaaaattttctaattgtgagtatatacctagttataagaatttgattcgtacctatacctatcaacaaaacaactcaaatttaactttatttcacaatccatgattacatacctaactaattatatgtatggatgctatatacctagaatcaaaatctaacaaaaataagttcaaattcagttcaaacttgctttgaactagttagtaaaagtagttaatgttaataccctaaataattaaaaaagtttcatactcatttgaattgggtatatactcaatttcaacaatggtgcccgggcaccatggagcaccaaacaaatttactatatatatatatatatatatatatatatatatatatatatatatatatatatatatatatatatagacacacacacatatatacatacatatatatatatatatatacatatatatatacatatatatatatatatacacatatactgtatatccttccaaacaaacaaccttttcttttctgaaaggcaagaaaatggattgtcccctgttgccatcaaggggacatcagtacgcatttagttactaatccatacaatgacatttcgacaagagcgagttggaaaaagggaaagctcaggggggcgcacttttccactggagataacggcgaagtgcgtgtcccggcgtggacttcgccggagtccgccgcccaaggtggcgctggtcggcacggcactgcacgcctcgaaaacgacctacgccttctcgctaattaagctccccggtcaggtcactctatgcttaatcacgaccaggtcactgcaggttggagttggattccggcgccggcgacgaccgtggacggacgacgacgagcagggcacgtcgcatgcatttcacaaggctaattaactagagagattaattaactaagttgtcacagggtaaaaatctgattacgagtactaattaatcagagttaagtactaataccatgtcctaatttacctgacgtacaggttatcactaacttgcaacgacgaagtaagaatggtagaattcacatcaatccagctgggacccgaccaacatggcaccacgtaatagcgacactggtgttgacctccatcccctataaaataatgtgcatgcatggttaattttcctcctcactcactactcaccctgtgctcaaactattcagaccctcatcacttcatctcagcactaggtaaacacttcataattcgtttaattctttcttcaaaagaatccatagatcacattctctcatctgacctatctaaaaaaacctatctaaaaaaacattctctcatctgttcttctgaatcttacttctgttagtctgtaattaatcaagttgttaattgctgcaaaaggtggccggcaggtgtaccactgtacaggatggagcctgcaggtgggcgagtcgtcgtcgccggcggcggcggcggcggcggccggcgaccttccggcgtgctgctgatgctgtacgccgccggcgggatcctcatcctgaactccacggcgccggtgatgaactctcacgtgctggccatcatgggtttctaccacgccatgtggctgctgggatgcgccatcttcttcgcattcctggggtagaagaagaagagagatcgctgggggtgaaatctttctttgaaacgcgcgaattttgagagaatttagttttggaaagattctcacgaaattcggctgtttcaaaggaggccttgactacgtcacgtatactactatagtaatgtttgtttggtttgtttttttgtttttgttttttgcgttaatttgtgcgtgcctgtttccgattttagtttgggaaacaagaagtgtaatcgggttacctgaatttatgttggaaacctgaagattaacggcactactcttgtaataatacgacttgcttattaggagtatcattgatcactactagtagcgttgaatagtcttcttggtaatgtaatttttttttcaccattgccatttttgtaagggtatatgatgatatgtcaaattataaaatgcattggcaacatgtcaaattgggactgcctatatatttgtcgacaaatttttccctaaaaatttgacagatgtaattataggacaatcgtagtgtaattacaatgtaacttctatgtaagtttcacataattttgaatcgttagatctattacaaaatttgtcttggcgaggaaaaaaacaaatcatagcacacacatatatgaaagaatttgttcccacgaccttcattttaccgaaatatcatgttatggagagatttttgaaagttacatacaagttacactatagttacagtgtaattacatgcaagttacagtgtaattacactatgattgtactgtaattacatctgttaaatttttgggggaaaatttgtcgacaaatatatagcaaaatcgtgtcaaatttgtcttgggcatttggacttttgacttcggatgggccgggcccagtctggcccatgtgcagtggcagcctcctcagccacgagatggagaggaggaatcaaaccaaggtgcacgcgcttttctcctcgcaaatccccaattcctcaatcgctcaagccgccgccgcggcgaaccctagcctcgccaccgccgcgaaccctagcgtcgcgttgcctcgccgccgctgcgagccgtcgaaccctaagcctcgcctccgtgtccacccgccggcctcgacgccaccaagaaggtgccgagctcggggggttgtacgttcgccgcgctccggcggaggccgtctgcgtcgtgggggaggtaagcatctctgcctcgatcggcgacagatcctctcatgctcgcgttaagattacgcgtcccgatccgtatattggtcaatctgatgcgtatcggcgatccatatttttctttttttctctcacttcagcagcatattaagtattgataaaacttgatttcctgctttgatatgcaagagcctactccctcggtcccataaaaaaccaacctagcaccggaatatgcaagagcctgctatgacatatcctagtactataaatatgtcctagtactgaaatatactccatccgttaaaaaaaaaccaacctagatgaagataggacaccagctagaacaatcttaggacggagaaagtactaccttattgcttatcttatttcatactatcaccatttggagtgagtgccatttggctgtgttcggattctagtgatgggaactaatctctcccgcacggaaaacggagcagtccattagcgcgtgattaattaagtattagctaatttatttttaaaaatagattaatttgattttttaagcaactttcatatagaaacttttaaaaaaacgcatcgtttagtagtttgaaaaacgtgcgcgcggaaaacgagagagatgggttggaaacatgggatgcaaacggggagtcctaagagcaggtacgataagctgactaggcgggctgcaaaaatataccacgtcatcttattcctatgtggaggaaagagaatagatgagagagaaggaagcgggcgactaatctgtcgccgggcgatacacttttctcgacgcgctaccgctcgattgcagccggccctggcgataaaaacgcggtttgtggggcccgcacaccacagccgatcccgcaacgctccctccgcttccccctcgacgcatatgcggcgcgcgatctctgcctcctcggcgcccgctcgatctccgcttccctccagcgcgccatctctggatgcagtcaggctaccggcgtgggcggccaggtgcagcggcgtgctcccaggccgggaagcggtgggcacggagacgtcgtccttgtcgaacagcaggtgcacgcatgccaggcggccctgcctggagcgctggagctaggtgcagcagcatggcaccccgcgtccctgacgtagacgaagcgagagaagctcctaaggcagcgacggtccggtccctgcctgggataataatattaattatgggttaatctagttagttgctatggtatttgagttatctattagtgcttgtagtttccatactacatagaacttggtttatatggtagtggtagtgtttgatgaataaaattcatgtcacagcgcaaatggctacagggatataattcactcttaatcctacacattgacatgtgcatgttataattaattatttgattataagatgtagtcatccaatgaacaagctattgtatctatagttggctttaggagtatactattagccttgctctaatgggcgatcagtcgcgctctctccacgccgcgcgatcagttctgaccctttagtctctcctctctactagcgttttccgttttttttttcggtttctcttgtgcgcccgagttttccgtttcttttttgtttttttcggtttcattttttttgtttttttctgtttttcttccgtaccttccgttttgttttttttctgtttttttctttccatatcttttcctgtttttaatacttatgtatgcaaactttatatatttttgtatacgtttatttttaggtttttatacgtacgtataccaatttagtatacatgtatacaaagtttgtatacacatataaagtttgtatatgcgtatttttttgggtttttatacccacgtataccaattttgcatacacgtatataaagtttatatacacatttacaaaatttatatacgtgtatttttttaggtttttatacgtaggtacaaatataaactttgtatacgcgtatacaaaccttgcatcccgtacgtacacatatataaactttgtatacacgtatacaaagtttgtatacgtgtatacaaagtttgcatacgcttatactaactttgtatatgtacatattaaaaaccgagagaaaaaacatgaataaaaaagaaaatacaaaacttagtatacatatgaatataaactttgcatacgtacatcttaaaaaaactgaaaaaaaagaagagaaaaaaaagaaaaaaaccaaacagaaagagaaccggaaaaaaagaagagaaaccgaacaaaacccaaaaaaaccagaaacagaaagagaaccggaaaaaaaaggaagagaagcgaaaaaaaccgcgtgggcaccgtccgccgccccctccgcgcgtgacatgtgtccagtcgcgcgcccgcgcgactggtcgcccattagctttttcggatgcaaacacatccaagttgcgatctgtgcacttcgaaggcattccatattagtatcctgttgtaaattaaagtatcagtacatggtttctggatctaggaattttagtaataccataataacgctaagttagtctattaaccagcccagtattaggtcaaatattatcgttatcgttcctttaggaagtcacaagctacgtacattttgtaccattagtaaagtcaggttggtcttcaagtttgcacattctgatcgcagtgtagaccaaacaagtcgcaccgggccctcttatttgcacattcgaattgcagcgtgggccaacaaggtcatgattgaatcccctcgtgggccgtggcccattataggttcacatgcgaacctacacacaaccatgtttcgcccctactcaacccatgaaaacataaacgccaaagtataaaattttgttcaaagaagagggagaataaaggtgcgatttagtcagagaattttgttaatgtatctaagtagtggcatatctcgaatagctataaaattgtaattgggttgttacaaatatatgataatggcacattgtaaaacaggagaatttataatgatatttttttagataatggaattaaaatctaattaatcctcattttcaaagtatatcctgacacgctttaaattcttgggggcttaaaagttaatgaaaatggagaaagtcggtaggctacaggtgtccattattaacatgaataatatgaatatacttcaacggtgtccattattagcctattctgcaacaccccaaaggggaactgatacataataacttcaccaaacgcaaattcctgaaataatggctgtgtttagatcacgataaaattgaaagtttgattgaaattggaacaatgtaacgaaaaggttgaaagtttatgtgtgtaggaaagttttgatgtgatggaaaagttaaaagtttaaagaaatattttgaaactaaacacggcgaataacgagtttgacaaaatttcgcatcaatggatgcgatcgagtaaacaagtcgaacagaaaaacgagagggatgaacaggtggtcactagccggcccactagcaatgtgaacagatggaaatgtccgatacccaccggcggccgatcgagtccttttttctgtacacgtacgtcacccatgtgacattccgatatccaatgttttggtcgtcatctaccaacaaaattaaatcaatttaacaggcaatctctaaacttatacacattttgtatacatttacaccatatgcttatacattttctatatgtagcaaatgctactgtgatagtatagtatcgttcattttacaagctgagatgttcaagctataaactcgacacgaatacacgatggatgtaacacgtctgtatttccactggtatgtgacatatactcctatatccatcgcatgcgtgcttttgtaaagtggatgttgcatgcatacataggctatgttagccagaaagttggtttttatcattggatgaatatatagaagcattggactgaatttgacatatctaagtcccacaaatctagatagaagcatgtttgaatttgtagtattatgatatattaaattcgatcccaagttactatatattgaaatgaaacttactccctctgttccaggttacaatgcattttgacttttatctaaatcaaactgcttcaaatttgatcaaatttatagaaaaaatagtaacattttcaatccaaagacagatttattatgaaaatatattcaattattgagttaataaaactaatttggtattgtaaatgttattatatttatctataaacttagttaaacttaaattttttaccaaagttaagatgatctataaaatgaaacgaagagagtaataacttgtcatggcctcgtgggtgtatcgtttgtgttgtgttcttttaagaaagaaaaaccattcgttctcgttttatggccttggacattgtcagtgacatgggatcgggagtatcatgactagaggtttgaggcagacacaatcgcccacgtggcctggcaccctcgggggacgtcgggcccgagggtgatgtgttcgccctcctcttagtccccccgagggggtcgagccgcacccgcctcggccccgagggccgaggcgccccgacccctcgtgggttttcgctccgcgtgtatgggttaggtgggcacagtggggctcacctaaccacatttattgcggtttggctgagcgtgtcacgccgcatgtaacgcggtgcagtgcactcatttatccggtctgtgaccagtcacagaccggtcagatcgcgggttaggcggcgacaggcgatctgacgcacgcctcgctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctgacaccggtcatgtcgtcagcagacagccatgattccgcgtcgcgcctgctcccggcgaaagtggaggtaggtgcgggccgtcccatcagaaggtgactcgaacggcaaccatgcaaatctccgtccatttatgaaaaggtagggtaagtccccacagagagggggggatggtgcatgcggtatccccttaagatataaaaggaggaccttgcccactgagagaaagggaggtttttttttttggactggacttttccagattagaaacccagaacaagggagaggctggctcatactttgtagctccttcacacacgaatccaccaaaacacaggagtagggtattacgcttctaagcggcccgaacctgtatacatcgccggcgtcttctgtgcttcctgtctcgcgaaccttccacatacagattgggagcttggagtctcacctagggtccccggccgaaccggcaaaggggggcctgcgcggtctcccggtgaggagccccacgctccgtcagacatgtaaaagaaaaatgataaagttgtgtttagatttagggtgtaaagtttgtaaaggctgtgtttagttcacatcaaaattagaagtttggttgaaattggaatgatgtgacggaaaagttggaagtttacgtgtgtaggaaaattttgatgtgattgaaaagttggaagtttgaaaaaaaaactttagaacatagactaataataaaacaaattatagaatccgcctgtaaactatgagacgaatttattaagcataattaatccatcattagcaaatgttactgtagcaccacattgtcagatcatggagcaattaggcttaaaagatttgtctcacaatttacacacaatctgtgtaattagttattttttcgtttatatttaatattcatacatgtatccaaacattcaatgtgcaagatgaaaatttttgccagggatctgtgacctagatatatgtaaccttgcacacacttccgaatacgttcgaggaagctgcaccatatgaatcaacgcgttattaatacgtaatcagcaagtcttagggcatgtttagatggcaaacaaaaattaccccaacatatcgtatcggatgtacaaacacacatttaaaatattaaacgtagtgtaataataaaattttgcctataaactgcgagacgaatttattaagcctaattaacttgtcattagtaaatgtttacggtagcaccacattttttatcaaataatgacgcaattaggcttaaaagattcgtcttgcaatttactggcgaactatgtaattatttttttctacatttaatacttcatgcatgtatctgaacattcaatgtgacagcgtgaaaaattttatttgggaattaaacatatccttaatcatcagcacttcatcaatataaaagaacaacccagcgtcgactaatccactacacaccacgtgatttcctctcccaaatccaccaaccgtcctccggtctctcctgttcttcgctcgatcctccaatttcctctcccaaatcatctcgagtagtaatcagtgtattttgttgcttatttcgatcgatctcatcccaacctgttcgatcgtcgcctccgccgagttttgctgctcgatcggatcggtcaaagcagcacaccggcccggcaagccatggagctgacgctgctggtgttcgtcctcgtcgcggccttctccttcgtgatcggcacggccgtcaccacggcgccggcgccgccatggccagcggcggccttcgccgcctacctcttctgggtcgtcgcctccgccgccgtcgccctgttcgtccgccgccccgccgcgtgaacacacacaccctcaccaactccggccggccaaactcaactcggatcgagatccagtcagtgattctaacccttcacttcctacctactgctccgtccaaaaaaaaaagaaaaaaaactctaattatgaatctagacacgtatatgtctagattcgtagttagaattggattttttttttttggacggagaggtaaacagctagtagtatctcaatctgctagctctatccgccgcctcgctcgatctcggcgttcgcgcgcaccgcacgccggcctgaatggctccaagggaagggaactcctcttctctctctctctctgaaaatatacttagattataatataattcactttgcaggtttttattttttcgaaccgcttttattttattttattctttaacgaaattgatttcttcggtttcataggcgttcaatcgatagatcgatggatcgatctgccaaatttccccgaggaaatttctgctacctccctaggcacacatacatacatataataataaccatatacatcaaattaatgatgtgttacttacagatgatttatatatattagctcatcgatctctcctgatgcaggcaaagggatccaccacaagcggcgcgcggcagccggccggtcgatcgataaccattatatatattcatttggaatgattactaatgctgcaggtcaatatatatcaagatgctgtgttatatttggtgaatatattgcgagttcttcgtcagggagagacggacaatcaaattgtcgtctcgtcttttcgatcaaagtggaggtgctggtggatcatagttaaattcgcaagtctgcgcattcatgaatgcctgaaaaatcgaaaagaggaaatatttattatcttagaatgttatatgcatgtaaatttggatgttgtgattatctcggcatcttataagagtggataaaaaatatttatatacagtacagtacatgttgcttggctatttgtggatttacgattgcttgtggttagtgtttttttaaatagaaattgttgtattgttttcgagttaattggctattgtggtttttgtaaagaaatggggtacatgtatcttttattcttttttttaagaaagggctgaaggtttgtcacttttgcattaaataggacagaggcacaggtgtcactttagacactaataaagttgctctgtctgtgcgtaattgccttgtgctggttaatagactttttaataaagttgctcagttgatctgagaaaaaaatattgacccagctagcatcagcttacactcacgatcctcatgcaaaatagttaggcggacgtgatggttaaaggctgtgtttagtttagcgcaaagtttggattttggttgaaattaaagatgatgtgactgaaaagttctatgcgtatgatatgttgatgtgatggaaaagaactgaagtttggatttaaactttgtatctaaacacagccaaagttagtcggttcaagcccaaaaagtacgcaataatttttcgcaaacgcaatgataacgcaataatgaaaggttgttgtataaagttggacgaatgaacggatggcaatggtaaatgagaaaattaattaagcagctaaacacaaaacaaatgtctgccttagcccctagccagccattcacacgcggaaggaagagaaccgagcctatccctgtctctatctaacgaggactcttataagctagctttacaaatttgatagtaggatttgtatcgagacgtaactaaatcgctagtaaattctacgaatatgttccaaagtgctgcgtagaaatactcgtactccacgacatgccttttcaaagaagccatatatacatgagatatcgtgaaatacgagtgaaacttactgcagtaaaagaggagtcgtcctcctcctcttcacctagccaatcatgcgtcccaccatccagaaaaaaccaaacagtttctccagaaaaccgtcaattaggaaaaataaccaaaatataggtggatccaaacacggtgtactaataacactgtaaataggttttattttgttatgaaatgatatagcatggataatttactaatatactccattcgtcccaaaataagtgtagttttgcactattcatctctaacgtttgaccgttcgtattatttgaaatttttttatgattactatttttattattattagatgataaaacatgaatagtactttatgtgtgactaattttttaaaaaaattttataaatttttcgaataagacgaacggtcaaacgttagacacgaatttccacggctgcacttattttaggacggatgcagtaagtaaaagaagaatccaatccagcgaagtttgaatgaattaatcggttgagcaacgcgtgggagtagaataaaagtgcagggaaaaaggaaccttactcgtatcctatcagatcaccggtttgccgtatcaacgaagcagagagagcactagaatgttcaccaaatttgtcaaacccaaaagtctagtattggcagaagagcagcaaacaaaagccaattttgcctccgtcgtggaggtccaatctcgatctcatccgcttgtttttgggagacaaacagagagcgaccggccaaatggccaatggtcggtttgagtactggccccacatgcatgccagtgtgtctacagcttagagcaagactaataatacaggcgatttgttagctataagattctttgtagcattctctcagcccacccatatactccctccatctacttttgatagttatattttatcttggcacacagaccagggataagtaattctacttttcattcattaaacatactattagttattcctcgtaaataaacgattcattaatatttacatttatcgatgcccatgtagccaatcttgtgtagaagaatggagagtcacacattaaatcctagaaagtcattaaaatggtaggttgttagattgaaatatgcctatcaaaaataaatttttcagatttagaaatatgactatcaaaagtagatggagggagtaatagctagctctttacaattaatatatgacatacttatctctctcacagagtttcttggttcttgtgtccaagccagctataagtttacatcccgcttctcctctctctcccctcttttctcctccatctcagcatttagtcggcttatagcctactaagatacttgctcttacgcccaactcgcattgctcacttgcattgtcacctgctcaccaaagtcgaagaagttgcctctgaaattaacatgggaaatcatgtcgacatggtgaggttaaagaatggaagagtttattgtacttgattcccttgaacaactcaaggaaaggagaacaattaggactaaccaacctcactagcttacagaaacgtgagcacaaagtcaatcttttaaaaattttagagtcaaatacatagtatacatttttttcgagagtcaaccacagctgttagcaccagtttaaacaacaccttccgagagtttacctaaaacaacaacaaaaaataaaatgaaataaaatagtgctaacattataaaacataacacgaacaattctagcaaaggaattttttttaagcctaggcaagccttatattatcgtcaataggactaggttagattataaggctataatataatcttgaaatgaatgctagcaagttgttattgtcagtggcgaagctatattgttcttgggtgcacatgaacctccaaattcctaatttctcactcaaaaacactagaatgtatagtgttgtactaaaattttctaaatttttaatgatagtacacccccttgttttgatgctagcttcgtctctggttattgtattggcccttgtggccacgtacagcgcaatatgataggtttggcccttgctttgctcgtttgctagccgatcatctaattaattaatctttattagaacctagctagcataattaggcacataattatagtaatactctgtataaagcctaagagtttaggaataagttcaccggaggtccctcaacttaacagcgagattattttaggtccctcaaccacaatactagaaatgttcgtccctaaacttattcaaaccgttcactggaggtcccttggcagtatacgagggtggtttcgctgacgtggcatactagtcagcaaaaaaaaatttaaaaaaatacgtggggcccacatgtcagccactctctcctcttttcctctccttctcttctcttctctctcttctctcttctcttcctcggtgaggggaggccggcggcgagcggcaaaatagcacggcaggcgggcggcgcggagcaggcgggcagatgcgggcgtggcgtccgggacggagcgggcgcagcggcgcgcggggagcacgggagcgacggcgagcgagtgtgggagtagagcagcggcggttgagcgcgacgacgggcgcggggagcacaggagcggagcagcgggcagcgcgtggagtgacggtgggcaagcgtgggagcggaccggcggtggtcgagcgcggcgacgggcgtcgggagcgcgggagcggagcgacagcggcatgcgagagcggcagcggtcggcagatgccaagcggagcggtttgggagggagggggagacggccggcaagcccgtccgagctcgcccagcctgcgcacgagtggaggtgtgccgccggcggacggcatgcgggttcgacgatgaggaaagggggagagatgaatcgacggccgacgacagcgaaggcgggcgtgcgcggcactgggctgctcaccgtcggcgaagacgagacttggagcatgacgagcgccgccgctctcgcccgccgccccgcccgccgctcccaccgtcccggccgcctctctccccctctccgcgtcgcccgccgccctacccgccgctcccaccgtccagaccgcctctctcctttctcccgcttcttccccgcgcgtcgccgcgcccgctccgtcccggatgcctctctccccctttccgcgtcgcccgccgccccacccgccactcccaccgtccagaccgcctctctcctttctcccgcttcttccccgcgcgccgccgcgcccgctccgtcccggacgccgcgcccgcatttcctcgcctgcttcgcgccgcccgcctaccgtgctcttttgccgctcgccgccggcctcccctcaccgaagaagagaagagagaagagagagaagagaagagaaggagaggaaaagaggagagggtggctgacatgtgggccccacgtattttttttaattttttttgctgactaggatgccaagtcagtgaaaccaccatcgtatactgccaagggacctccggtgaatggtttgaatgagtttagggcgaacatttctggtattgtggttgagggacctcaaaaaatctcgctgttaagttgagggacctctggtgaacttattccaagagtttaatgcatgcatggagcccagtcactagctcaaggtggtcggcctcaacatggccgaatgggttgcctggctcagctcggcctgggcacagccaaggcccaaccccgccaaacggttgggccagactgtgcccaggcactgcccaatacgaggtgggccgactcgaaggcacgaccagcctcttgtgctcattcttggaaattggaataagtcttttttgccttcctcctgtttgggccgtgtcttacatatggcagaataagttcacttcacgtcccattataccgctagttgacaccatgcataccactttgctaggttttgtacttacattacttgacaccatatgctagtgtattattcctctatctgcatagtcaaaatctcttctattacaaggcagaggaagcaaattacatgttctgttttgtgtctcagtttgttgagtttgtgatttgaattttagagtatgtactgtatttggattagtttcctagattttttttatatatctagacatatcttaactctagatgttatatttgtagtggacttgtggagcagtctaaacctaactccacttatctagggttgtgttcagatccaaagtttggatccaaactccagtcattttccattacatcaacctatcatacacacacaacttttcagtcacatcatctccaatttcaaccaaaatctaaactttgaatccaactaaacacagcctagatcatataattcattcgcagctaaatggaccaacaagcaatagctacacctaattaattactcgtagtacactacccagccaggcagccagccccaaacatgtgtgacacatattacgtgatagagggatagagacagaatgggcaagatgaattcatataaaagataatataaaagaagtcttaagtgttccatctttgtgatagaaacaattgatcattcttactgccgtgctaattttgttttaaaatatcgtttgtcaacactactccatgcattgcgcaaataccaaaaaaacatttttactttcagtgacattttcagtttatatagattcttactaaaattaaaaatatcagtgtgtatcatagctggtcacgtgcactaataatttttcatcttcttcggaaaagtcttaggtgctctttgagatagattcaaataaaaatgaagtcaagatgtgtaaaaaaaatattagcacataattgattaagttttttattattataaatttaaaatttagatttccttaatgtaattttgatatagaaagttctttaaggaatacactatttagtatgtttaaaaagcatgctaatataaaccaaacaagactctacagcactgcaaatacgcatcttaatataggaaataatataggaaatccaaatcctacatcgacgacttgccgctgatcgatactgggagtagaaaaaaagtttcgagccggaagcaacgacaaaacagcggtcagacagacgcacaatccccaaggtgtctgatctgatctcaagttctgaattctgatcaagtggcgaagagaaaagtctgtagtagtctgatctgcttgcattgcagggcagggtagcatgggtacgtcctgtcaccctgaaatctttgtatgcatgcaatgctgcgatgagctgatcagattgtctttgctgctgctgctgctgctcttctcctctgcctgcagcttcgccatgccattgtcccatcacctcatgtaccactgctcctactgccgcatgctcacgtgtgcctgatttcctttccttgcatctcgatctgcatttgcatgcacacgaatactactactcacacgtgtgcaccaaaacccccgtccactccagcacacagatttgcattgtcactgaattggccaacaggtgattgtgtgcgtttttagctgctccctctgtcccataatataagggagtttaagtttttacttgcaacgtttgaccactcgtcttatttaaatttttttgaaattattaattattttatttgtgacttaatttattatctacagtactttaaacacaactttttattttttatatttgcagaaaaaatttgaataaaacgagtggtcaaacgttgtaagcaaaaactgaaaatcccttatattgtgggacggagggagtagtacttaaaaacctaatattaaaaaaaaacaatgttaaaaatatcttaaagttaactctaaaattaaattcaaaatttacccgtgactgattctttttttccccaaaaaatgaatcttccttattcaataaggcccactatgatttgtataggagaaatatagaaaattgggaggattttaataatataaaaaatccctaggaaggcatgaaacaaaggattgtatcctattattttgtttgaaatttctatgcaattggcaatcttatatatattttggagaaaagttagtaaaagctcaaatctcttggaaaaaaaattccgacactatctctctcatccaattttgatgtttttcatgcggcctaatgaaacgattagtcctatttttatccaatgctttacagtcatttattttgcacttactattcttgttaaaataatatgtttttattattcctctcttttttcaattttgtaaaactagccctgatttactttacagtgtattatggcttgctaggctggaaaatgtattaccactactattttaccaaacgatcgaatttagagtctgtacgtagcagggatacagtgatgtcatttcaaagtactcttgtatgcataatcagatcgattctactgtagggtcatatctagaacaaactaacaggtgatcaataccatctcaccagaagtttgcctgcttgtttttcgtccctcacacatgttcagatgttctcccttggcctataaagagaaaagattatacggagtatattttttagagatattaaggatataaatggagaatacttttatatacttctactcaatggttagagagtggacgggtgattgatagaacaagtagtgcttataaaatcccttatatttattgataggtgctcctttaaaacgtggggttgagaaggaattaatataagaaacacaggatttgatcagaaaacaagcgtaaaacagattattgcaaacatagaaaaaaacgtagctaacgtctattttaataaaccgtagaaaaaagtatgaattgaaccagacggatagacttgagccattatttagtcatcttttctagatttgaaaagctccgatcctttatttcaaaaggccaaataggaaaagtttatgtgtgatttgaatcttaccaattaaattctttcacaaatcctctatttcaaagggcctaaatgttgctcgtaatatagctattctatgaatatccagcccctccaaacaatttaaattcttaccctaaattttgtgactagtggttacagaattcagaaccgtcccaaaataattttagttttcacctatgtcacagctaccaatagaattatagaaaggccaaaagagtactagaatacccttgacatactagtatatgtcattgttctccactttatctaatcctaatacatttacctgctattttgacaagctccaataaaatgattgcttattgaaagataaaattatttagggacaaataagattgtgaaaattgaaattattagctatcttttttattagttgaactactctctcgttttttataagcccgctttctgaactgctaaacaacatgcttcatataaaaactttctatgtatagaagtttcttcaaaagggtcacatgaatatgttttcaagcttataatagttaagactcgattaattacacgctaatgatccgttgggtttcacgtgccaaaatcagctcaaccgcaaccccacaatcgaacccatccttaaactatttagagaattactggtgcagatttatctacttgattatatgataaatttaatattttataaaattaaacttaacaaatacagtactactccgagtaacttggtgcagcacttctaccgtacaaatggtctactacgagtactcctaactcttaagggagttagtaataaagattttttttttccaaaaatataccactcaatccgtttcatattataagtcatttaatttcctcttagtcaaacttttataggttttactaaatttataaaaaaaaagaaagatctataacaccaaatttgtttaattaaattttaacattgcatacattttggcttgtttcgcattgaaaatattagtatatttttctacaaattcgatcaaggccgtgtttagttgttttggcaaaaaaaaaaaagaaattgatgtatacggacacacatttgaagtattaaacgtagactaataacaaaataaattacatattccgcatgtaaacagcgatacgaatctattaagcctaattaatccttcattagcaatgtttactatagcaccgcattatcaaatcatggcgtaattaggctcaaaagattcgtcaagcatttgacatgcaaactgtgtaattggtttttttcgtccacatttaatgctctttacatgtgtccaaacatttgatgtgacggaaaagttggaagtttaaaaaaaactaaacacagtccacaaatacagataagtctgattaagaaaaaaatcaaaatgagttataaagggaggattatttaaagcacataatttaaaccgacagacatattgctgtaaaagcgcgtggtggtacacggtacacacacctcacatcagccatcgctacacagcagcatactccctccgtccaaaaaaaaaaaaaagacaaaccttgtgtttccgtgccaatgtttaactgtctgtcttatatgaaatttttttataattagtattttcattgtcgttagatgataaaacatgattaatactttatgcgtgacttatctttttaattttttttcataattttttcaaataagacggacggtcgaacgttggacacggaaatcagggtttgtttttttggacggaggaagtaggccgtttttttaacaaattgatccttttcaaaaacttatttcgaaactagtccctgcaaaaaactttaaccaaaaataggccacggactcagcgtcatggacattggcgctaagctataacatatcagcgccaacgtcgttggcgctaaactctaatccgaggtggcatgaattcgctgagtcatcagatcttagcgccaagttatttggcgctgaggtttagacgatttaaataaatgcggaggcatttctagcaacaccccattgatagcataatagtagtagagttctactctatccttaaagagcagggttcaactcccatctctcctttttttttctttccttttagtttccctttttcttctctccctcactcattattaatattttttttctttttttatctcgttttctttttcttttttttccttttagttttccctttttcttctctccctcactctttccttttagtttccctttttcttctctccctccctcattattaatatttttttctttttttatctcgttttctttttcttttttttcctttgagttttccttttttcttctctccctcactctttattaatacgttttttctttttttatctcgttttctttttctatgtttatttatttattttctttttttcttgtaatactatcttcaaaatatatgtttaatatgcaactttctttgaatttgaaaaaaatattaaagtgctatattatatagcaaatgagaatttaaactgaaatttcaaagaaaattcaaaatatttttcttctctccctcactctttattaatattttttccttttttttatctcgttttctttttcttttttttccttttagttttccctttttcttctctccctcactctttattaatatgtttttctaatccaaaataattttcttctctccctcactctttattgtttttttccttttttatctcgttttctttttctttttttttccttttagttttccctttttcttctctccctcactctttattaatatgttttttttctttttttatctcgttttctttttctatctttatttatttattttctttttttgtcttgtaatactatcttcaaaatatatgtttaatatgcaattttttttaaatttgaaaaaaatattaaagtgctatattatatggcaaatgagaactttaactgaaatttcaaatcaaattcaaaataaaacaaatttacaaacgaaacagtcattttgtaaagaataagagtgagtagtgaagagaacaaaacttatttcttttagttttccctttttcttctctccctcactctttattaatatgttttttctttttttatcttgttttctttttctatctttatttatttattttcttttttttgtcttgtaatactatcttcaaaatatatgtttaatatggaactttttttaatttaaaaaaatattaaagtgctatattatatggcaaatgagaacttaaactgaaatttcaaatcaaattcaaaataaaacaaatttacaaacggaacagtcattttgtaaagagagtgagtagtgaagagaacaaaacttatttcttttagttttccctttttcttctctccctcactctttattaatatgttttttctttttttatcttgttttctttttctatctttatttatttattttcttttttttgtcttgtaatactatcttcaaaatatatgtttaatatggaactttttttaatttaaaaaaatattaaagtgctatattatatggcaaatgagaacttaaactgaaatttcaaatcaaattcaaaataaaacaaatttacaaacggaacagtcattttgtaaagagagtgagtagtgaagagaacaaaacttattttgaaaaatacatgaggaaaaccaggattcgatcctagtaccctatggatgacaacccaagcatccaaccaccatgctatcacggtgttggttctatatgttgcttgcgcggctatttaaatcgtctggacctcagcgccaaatagcttgacgctgagatctgatgactcagcgaattcatatcacctcggattatagtttagcgctaatgtttatggcgctgagtccatggcctatttttagttaaagttttttttgcagagactagtttcaaaataaatttttaaaaaggaccaatttataaaaaaacgggggagtaggagtgtaggcaacccgagacgtacaatgcgatgacctctcgagtcgagccttgagacaaatatggatcgatcgatcggagtcgcaccaccatccacgcacacacacacgaagtagtaggagtactcctgcaagcgttctgtgacctttgttctcttgtgagaaaaatcccaaatgatccgtccatgatcatccattgttgagctgaggtgacatctccatacctcccccactccccctcctccacattcaatgcgcgccagcttcctctcgtcgtcgtcgtcgttgagagagcagccagcaatggcgattcagagagagaaaggacagcagctgagagagagtgaggtgactagtgaggtgacaacctttttgcgtatagtaatgtggaaagccttgacgatatctgcgccactgggtccctcaccttgtctccccccttctcctccctctgacggaaagtcagagggacgttgtctaggacccataaaaattgagcccataacctacgtccctctgactttatgttagaggagcgcgatcctccttcaggatgaatctcctctgacgtagaactagagggactttgttactgacatgtaagacctacaaagattagacccacccacgtccctatgacttttggtcagaggagcgcgatccctccctccatatcttctcttctcttctcctctcccttctcttcttcatcgtcttcctcctcattcctcccttctgctggctcctgtatcttcttcttcttggcttcttggtaagctctctcgatcgatctgccacttgatttgtctgtagatcagccagcttgcctgcctgcaccctgcaacgattgatgatcttgtgtattgttgctgcttaattgctgggggattagctagtttagttgctactagagtgtgtttcttgtgttgatctgagtttgatttgattttcagttttgcaccatgcgatcgatcgagagtgtgttgttgttcttgttttggttcttttctagtagtatcagttgcactgattaattaattaatatagcttgtgttttgattcggtagacacggctatctgcagcgtatcaaagcttttcctgttgcacaccacacctaccatgagttcctttcaatcaatgcctaactctctctctctctcgatctgcagatcaaatatacaattcgccttctcgatcgagtagttgatgaacagtgttccccttgattgattgatcaccattattataacatcctctttctttcttctcactgtaccacacacttcgatctctgcagcctgaaccaagcaagaattatagtattagaacaactccagatatctctaaagctgatgatctagctctactttctgcatcgatcgatctcgttaattagggttagatcaccggccggcacagtgcatcttcaaataagcatcatttgctctttgagtgatacagtactatgcttccccttctgctgatctgctctctctgtccctgcatgtattacagttaatttgtgtcagttcttgcttggctgagctaagttcacgccagatcttcaaaaccccaatcttgctactgtgttttgtttttcttggaccacccagttatctgcctttttttatttttttccaaaactcacaaagctttgcacgtcaaacatattagaagaagcattgagataacttccagattagctgaaaccctagttctttctcattctgaatcatccacagtatgtcaaattctcaatagcattagctgcttggtttgaccattggtcatggggttgacgaactgacacgcagcaattaatggttcatgtttggcaggtgagagattgaggagatggacatgatcggcatggcgtcgccggcggaaagccccggcggcggcggcacggccaggccgagcaggtacgagtcgcagaagcggcgggactggcagacgttcgggcagtatctgcgcaaccaccggccgccgctggagctctcccggtgcagcggcgcgcacgtgctggagttcctccggtacctggaccagttcgggaagacgaaggtgcacgcccatggctgccccttcttcggccacccctcgccgccggcgccgtgcccctgcccgctccgccaggcgtggggcagcctcgacgccctcgtcggccgcctccgcgccgccttcgaggagcacggcggccgccctgagtccaaccccttcggcgcccgcgccgtccgcctctacctccgcgacatccgcgacacgcagtccaaggcccgcggcatcgcctacgagaagaagcgccgcaagcgcgccgccgcctcccacaccaagcagaagcagcagcagcagcagctggtggaacaggcggtggcgccgcccgccgccgccgccgccgccgcggcgctgccggacatggagacgacgacgacgacgaccacggtgccgcacttcttgttcccggcgcacttcctccacggccactacttcctggcaccggccggcgagcagcccggcggcggcgacgtcgcggcgtcgacgggcggcgctgccggtgctcccagcggcggcggcggggaggacctggtgctggccatggcggcggcggcggcggccgccgaggcgcacgccgccggctgcatgatgccactgtcggtgttcaactagctcctccatcgatctccattaatccttaagcttacgcagcttttgcaaatgcattatggcgatgggccagcctcatcgccatttgatcatatcaaattgctcgcaaatgcaaatttgcatggatgcgtggtgatttgcatttgctttgggattaattcggaggttttatatataattagctagtgcatgcacacgcacgtaatttgcatggtttttttttgtacgaaatgtttgtagtaaaattttaggttaatttagttataaactgtcactaagctagcggcaagatggtcagctgttggggcgcatgttaattatcttcatggctttgaagtgacttttaattaattaaggactggtcaacgaaatgccaatgtaaattaatcaattaaatcttatatatccagcgttgatcccacacgtacaagtttgtatgtattgtatgcattccaagaactgcaatttcgtaacttttactagttgtcttcaacttaaattgatgggtgttgcatcattaataaccttactcatttttttccgttacacaattttactctatcttttccctcaacacaattgatatttaaatttagacctattatactttcttccaaacattataaataccaaaaattatcccatgttactcatttattttaaaattctctatatggtgacaagttcttgggaacagagaagtactgctgtatacctccgtcactgtctcaaaatataatgatttggcttgcataatttactactagctcaaccaatcacgcaacaatcaatccttcatttaatttcataaattttcttaattaggatgtgatcgttgcaaacagatagagagaagaaatctctcgttcttcacgtgcaagcttcacaagctactaaacaatgtttttttaaaaaaaatctataagaaaatcactttaaaaattatataaatcaaaatttactcaattttcttgtttcttctcatatcaaacatatccataattaattaccatgaaaaacattagtagtgcatgtattttacttatcccatccaagtgagcttcattttcagtactctctccgtactaaaataagtgcagttttatactattcacaattttatactattcacgttcaacgtttgactgttcgtcttatttgaaaaaaaaattatgattagtatttttattgctattagatgataaaacatgaatagtactttatatgtgattaaatatttttaaatttttcataaatttttttaataagacgaatggtcaaatgttgggcactgatatccacggctgcatttattttaggaggaaggtagtacttgccactgcatgcattgacctccagcaccaaagcagctgtactggtagctagctagagcttggtcataaaagcaggagaaatccaggaaagattaggcaaagtacagaccacctaaagtcaagcatttctcactatgcctccatcgagcaatcagatcaacgactgatggatcagcatagagcaccttgatgagatgagatgagaaagagaagtttgatcgagactagaccgacgatggacgttgtgtggtgtgcgtgtgtacagtgtacacagcgcgtgatgtttgaagatgaagattattgtggtaataactgtgattaattgagttttaattattataaaaaaaagattaatcttatatttaaaacaacttttatatagaaaacaactttcatataaaaaaattttcacactctgtttagcaattagaaaaacgtgtcactcttatctaaaagtttattcagtttttattggagaaaaaacagcaccagcattgcgacgaccattcctgtcgttactgacgaaactgaagatgaaaagaatggggttagtcaatcgatcgatcgatcgatagacatggcttgttgaaaggttgcccatagaccatagaccatgggagtgagtagcctctgtgtggccggtgatggaacagccattgatcagccatgggagtcagtgtgtgtgtgtctgttgatctcatgtgcaacagtactttgctccttttgcttttgtgccgatggacttgcacaacgcatagtgaagtgtaccctttgttattgttgtgcacagtcaatgggatttgcatttgaatgggtggtggatttgggcgattgattgattgaggccctgtttagtttcgcacttttagcgtgtcacatagatatacatatactcctatatatttaaagtattaaacgtggactaataataaaataaattacagattctgcctataaattgcgagacgaatttattaagtctaattaatcagccattaacaaatatttattgtagcgccactacaattaggtttaaaagatccgtctcacaatttacacgcaatctgtgtaattaggtttttttatatttaatactctatgtatgtgtttaaacattcgatgtatgcatgtgtttaaacattcgatgtgacatggtgaaaagtttttgtttgggaactaaacggtgcctgaatgaatatatacaacctttaccattcatggtcaggtgattcgaatttgaggaatttttagtcatctagccctggccatggtggtttatatggcagggtgagggcatctcgccaccgctcgacttcaggaggataaggaggggcgtgacgtggatacaacgcgtggaccatgggaccatggaagtcgggaagacgtacgatgacacgatggtagatttagggacgaggaagtggaggtgagggtgtggctggccggttgatcacgccggtgctagtgagttagagggtgactgttgacgactaaatttggtaaatcatgcattattcgaagctaaagtcgaagtgtcacatcaacagtgatgacacgctaggttggaaatgcgagatggaggggcaaagatggcaatagctcaggcgttggaaatgagggagagagtgatggtagggttatataactttgcacgaatcttggagcaatcaaatttataaagatgattgatattagaaaaaaaatgggttaatagctttgtttggtttactgcctttcaaaatgctagcaatgccaaaatctcgacaagtttaatttggtagtgccttttatttggacaacttatgtattatgttaatattattttagtaacaagccgaacactatcaaagtactttttttttacgactcacaacaaacaatgcgaagttcatattgatagagcatgaaaaaaattacaagactccaagggtgggaggtcataaccagaaaacaaagaaaaaataaccacctcccacgcaccgacccaagaaaaggctagcaccaaaccagctgccgctaagcgtgactagtcaccgctaggcacacaaatgaaatacaaccgagatggcccaaaacctaacccttgcacctgataccaaactctactctagccatatctttggaattgagagagcaagggaatgaaaaggaaaaaaagaattgtctcgagacgagcctggattggtcgttctagcacgtactttgtccgtcctaaaaagactcgtttttaagtttgaatctaaacctacgctatgttcaaatttaaattctgaagttagtttatttttttggatagagaaggtatattggtgttggatgtgcactcgaccatacatgtatgccaaaatgcatttggatcaggtgtatactgcttgttgtgcgtgcatggccgtacgcgtagacacacagtaggtagcagagagtggtcctaattataaattgaaacaacagatcgatccaactgaggtttatctagctagccagatcgtagtggtcctgtgtataccagcgtagtacatcgcgtattgattggaacaacgcacgtacgcacgcacgcacgcacatattttggggcaggcgtacagtggcaacgaatgtgaaggggttagtactagtggcttaagtactgctacgctagctgtccatgcgcaagggtcatgttaaattaagctgtcaaataattatgtttcgacgatcgatgttctgtcatgaaaattaacagtactaatatgtaatatctccgtcccaaaataagtacagtcataaatatctgtgtttagcgctttgaccatctgtcttatttaaaaagtttataaaaaatatttaaaaaattagtcacacataaagtattattcatgttttatcatctaataacaataaaaatactaatcataatctttattcaaataagacgaacggtcaaacgttgaacataaatagtgctaaaactacacttattttgggacggagggagtatggttttggatcagataattcagagttagaaaatagacgtagagtatgtgttagccatattgagttgtgatccaaattcatttacacttaataaaagccaacttctaccgtagtggagcggaggcccgtcgtcggtaggcttaggccggagcgtagcggatcgtcatctcttttagggttcccccatatatatatatgggactccatggtgcccgggctccaaggtataaaacacacaaattctctcaaatttttaaaaattttcaaattgtgagtatatacctaggtatatgaatttgattcatacatatacctaacaacaaaacaactcaaactcaactttatttcacaattcattattacatacctaacgaattatatgtttaattgttatatacttagaaccaaaatctaacaaaaaaaagttcaaactcagttcaaacttgttagtaaagaagttaatgttcatatctaaacatttaaaaaaaatttatactcattcaaattgggtatatactcaatttgaatcttggagcccatactccatgtagcaccagttaatatatatatatatatatatatatatacacacacacctcttgtaagccgatatgcggcgttgtaacctcaccccgatatagtgaagatattttgctgactggcgcccgtggtttttctcttctgttttaggagggttttccagttaaatctcgtgtcttctgtgattgatttattgttctttatagtttgtttgactatcatttcctaacaagccacagggacactaatatgttagaatataaaatgaattgtccatcattttatatcagtttaggcttttgtatttgaattgaccagtgcatataatttaatacaggaaaaagatgaattaccccctaaactgttgcggtcgaccgaattaccccctgaacccaaaaaccaaacattgctcaccttaaactttcaataccagacgaattaccccctcgacccaatccagaatggttttgttcttcatggcgtacgcgggcaatccagtcagcattttcttttttaagaaaattatgggacccacctatcatacatccccttcctctcttcctctccctcttcactgactcactctctctcacggagagaccgccgcctccgtgtcaccgctgcctccgcgtcccgcgccgccgcttgctgccgcccatcgcccgcatgctgccgcgcaagagagagagaggaagagtgacagagagagaggaggggaaataggaggtgagcgagagtgacaggtgggcccaccatttaaaaaagtaaatgctgattagattgccacgcatacaccatgtaggataaaaccgctctggattggatcgagggaggtaatttgtccggcattgaaagttcaggatgaacgatgtctggttttttagtttagggggggtaattcggtcaactgtgatagttcgggggtaattcgtactttttccttcaatatatggtatcagagccagaagttttagagtttaaattatgtttggtgcatctcgttaacttaatcttttggttgatcggtgcatgcaactcaatactttcgtaaccttacctaacccttttatatttttagtataacaggtagagtaaatttcacaagactacggccctctttgtttaggcttaagcttattggcctagacttttaagtcatcttattggcttctatgatttataagccagtggatttaatgtcctaagtttagtggttgagccatacatctacctcacataagccaaaaaaagcttctccaacctagcttttggcttaatagtgttagagtggcttatggcttcaaaaaagacaaacggaaaagctgcttgtttatttaggcttagactttttgacttataagttggcttataagtctaaacaaagagggcctacaagtactttgattaagttatctcaaaactacagatttaagatgatttatcacaaattacatatttagtactgaatttgtcacataagtacaaataagcatcgtatcaccgaactacaagtctaatgttaaattagtcacaaaattaggatgtttataaatcaaacataacattagtactacatattcaaacattaaaatatatagttttaggataattttgtgattaaatctatagttttacggtacttagtttgaagcatgtagttttgtgataaatttattattaaatctacagttttgtggtacatcactttaaggtggtgtttgaatctcctgaagataaagataaatattaagtgtttcacgcaaaaacgaggtggtaataacgtgtgattaattgagttttaattattataaacttaaaaaatggattaatatgatattttagaacaactttcacataaaacgtttttgcacaaaacatatcgtttagcagtttaaaaaacgtgccacgaaaatccaaaatttaatcacatgaccaaaataagtatttatgtaatttagtacctatagttttaccaaaattactctaaaaagtactcctacccgctctattttagaattagccttcaatttttttaggctatcttaaaagttaggcttattgttcactcctaccaccattccattagagaaggtacaatagcagactataagtcagatataaacatattttaaggagataaaagagaagagagaagagcagcatggtacatatatgtagccagctgtagcacggacttcaaaaaatagtgtgtgtatgataggtaggaccaggtattaatagagtatgtaacattggccttgtttagttccaaacttttcttcaaacttcaaacttttccatcacatcaaaattttcctacacacattatgaccctgtttagatgggactagaacttttaagtccctatcgtatcggatgtttggacactaattataaatattaaatgtagactattaataaaacatatccataattttggattaattcgcgagacgaatctattgagcctaattaatccatgattagcctatgtgatgctacagtaaacattctctaattatggattaattaggctttaaaaaattgtctcgcaaattagctttcatttatgtaattagttctgtaagtagtctatatttaatactttaaattagtgtttaaatacatagactaaagttaagtccttggatccaaacaccacctaaactttcaacttttccatcacatcgttccaattttaaccaaactttcaattttcgcgtgaactaaacacacccattgtatgaattggctattaagttgactataggtgatttgaagttattagggcagtaggtactcctactctgcaattactattaaaaaatctggaagaagaagaataaaagaaaaatgttggcctagaaatggataccaatggcggtagctagcctaggcgtatattatactctactctaccatgaccccttcttcgctccatactctacaagtgtagagtactcctgaaatggagtaacgaagaccgacgaagatcaaacaaaaacgatcaaagcagaggagcatagacatcaatgccaatcgtcaaaatgcaggcaagagctagcagtgttggtcgtggcaacaacagtactaaaaattttctccgacagatcgagcaggacggacgccacgatggcccggatttgacgtgactctgatttgatctgtgatatgatgtgatgtgtgatgtgatgtgatatgacccgtcggggccctcgtcctcctacagaacctgaatcaaacgtcgcacccttttccaccgccgtcgcctatcgccgcaacatttagattttaagttaaaattaaagatggtgtgattgaaaagttatgtccgtatgacaggttgatgtgatagaaaaggactgaagtttggatctaaactttaaatctaaacacagccctattttaacgaggagtaactcaggagaggatgtttggttggcagttggcacgctcaatttgtctcatcttttagactacctccgtattaaaaaaatataagttaatttttcactccagtcttccggttagcctaatgaaacgtccaaaggtcttctggctagctccacaaggtggtgggctagatgacacgatggccgatctagacgacttgaatcaaatgtgggctagatgacctgaatcaaacgtcctgctcgatctatcgcctattagaggtagctccgcagggtggtgggctagatgacatggattcgaagtctcacaccttctaaatatttgatattagttcattccctaatattcacgtcttttttacccatttcacacatacagataaaaaaaattaaaatgtccttactatatcaaatctcaacgcaattatttctcactttatctactaccaatataataactactccctccgtctcataatataagggattttgagtttttgcttgtaacgtttgaccactcgtctttttcaaaaaaatttaaaattattatttattttatgtgtgacttactttattatctacagtattttaagcataactttttgttttttatatttgtaaaaaaaatttgaataagacgagtggtcaaacattgcaagtaaaaactcaaaatcccttatattatgggacggagggagtattatatactttcacaaattatgatgaaatgattactctataaataaacttattttgggaccaaggaaagatgctgaaaataaacttaatatgggacgaaggaggtggtagagatatcgatcaccacaatttttatctataccatccacttaaaaagtttagagttaacactctattacactagccccaatacacttgtcatcaatctacttcttttttttatctcgcactttttgaagtttgtataaagattgtccctttacgaaggtgggcttatcctctctcttttcttctctcccacaaatcatccttttagcctagtttgtttcttgtctaaattcgtattattagaatgtgactcgtctcattctagatttgtttctcttagagtggaggatggagtattttagattgccttatatttagtattttagatttgtttctcttatatagcgacctagtaccgtggtgaacatgaagagatgtttgattcgttttgttcgaggacgtagtactttaaggcaacatttgttaggaggacaaaataggacaaaatgagaacaaatctctctattttttcctggcacgctttctagtttcttaaattatgttttgatacagtgactttgtaaattttaagatatgtcggtctaaattttttttggaggttttcatagcaacaacgtgatgttcacaagaatgagcgtcaactcgttacgagtcgcatactatgttttaactgtattttttaattaaaaaaaatcgatgaagagcttgatcagcgctccagctgtgtgttgattggtgacgtgtcgttttctaacactgcgtgcgccatcccatcgctccccgcgtttcccggatcttggacgacacgccccacggcccactacctcccgtttcatcttgggctgggccccatttcgtcagtgctttgtgcatgccattgcaattgcaatgcacccagccaagcagaatggagtgccaccatgtgccacgtaccatgtcggttgccgggtggtatacatgggatttgggtgttcaattgaatatctaaaatctcttatattattgaacgaaggtggtatatatgtatactacttcctctgttttataatataggacgtacacacattttaagattagactttagaaacatttgaccaacaattactgtaatataaattaaattttatttgctaaaattaatatcattggactgatatttaaatttattataaggtggttataattttattgtaataaaccttatagtatgagaaattataagtcaaagattagttctataaaaactgtaccaagttttaccatgtcttatattataggatggagggtatatactactagcacaatatattcgtctactgatggtagtcgtagagatggcaatgaccccattttgggtcaccaaaaataagaaaacatacttttatcatcactgtcatcgtattataaatcggtacttccaacttctcataaaaacactagtagtatcaaatttcagaaatgttgcagattttgaatgtgaatgttggatcgcggaggctgtgttcggaacggttggttcccagctcatccgcctcgtttttcacacgcatacatttttaactgttaaacgatgtgttttttataaaaagtttatatataaaagttgcttaaaaaatcatatttatttatttattaaaaaatagctaatacttaatcaatcacgtgctaatgaaccgctctgttttccgtgcgcgtgtttttaacccatcgttacgaacagagcctaagaagggcctcaaacgcaatggagtctcgatctgttaggcgggcccaagctgtggatttcaccgggcccctttaggcccaattggcctagttctcgtgggcccggagttctctatcaaattaagtgagagaaaaaaaaataaaagcggagaaaacaaggcacgccgccgccgccgctcgatgcgtttccccgttcgcctctcgccgccggccaccgcggcggccgccacggccggcgccgtcctggccgccgtcgctctccgcaggtacctgcgcacccgctcctccatggccacgtcggcgcaccggcgcggcagcgccggtggaatcaccctcgtggtctccggcaagtccacggaggaccagcatctcctcgccgccgccggcggcgcgctcgttctaggggagggcgactccgtcgaggatatcaccgtgtcgctcgactccggcgcgggcgcgggcgcgggcgcgggcttcgacgccggcgcttacatggcggcgctccgggcgtcccgcttcgggaggtggatgctctggtcgcccaggctggcctccacgcacgacctcgtgacgcagtgggtgcaagatttgcttggttttttcttggcgctgtttgaattgggattctcttgttgactcctctcttgctcggagtgtgcaggaatttcgccaagcttccggtgggcgtcgtctgcgtcgccgacgtgcagttcaaagggagaggttagtgggatggattgatgaatagacagtctaagtggtgattgtttgttgctgttactgttctagatgtgatcaatccttgacactttaggtggattaattagtgttgtctgctctaatgctctctagttctgacatgtttgatggtactggatgtatgactcgagaaatagtgaacttggtggatgaatttggatttgtaagtaatccatgccatgtatgtactcgacttggttaaacagagaagtttcagaagtgagaccatcctggcaatatagtgcgagaaatgctgatcaaaacttgtttttcgatgattcagccttattgtttctacgaaaattctttggcttaccgcttacatatactggctaaaagagtccgttaagtacttgattgtttcatgcttccttttatccatcgccacaatgcgatgtgcatttagaccagatcctaatctcactgatgaatttatgcaggtcgttcaaagaatgtgtgggaatcaccaccaggatgtctcatgttctccttcacttcacagatggaggatgcacggaaactgcctcttatgcagtacgttgtctgccttgccatgaccgaagccatcaaagaactgtgttgtgctaaggtgaataatagtgcagtaccactaattcagtgattattcgttgtgcagaccatttatcacattatggatatttccctcaacagaatcatggatatttttctgagcttgaccatctttgtggttcaaatcaggggctttcagaacttgatgttaaaataaaatggcccaatgatctctatctgaaagggctaaaagttggtggcattctttgtacttcgtcttatcaaccaaaagtatacaatatttgcaccggtgagtattatttctaatactgatgataataataccattcaccaccaaatgttaaggtatttcttaagataaatttgctcttatttctatcctttccaggtattggtttaaatgttgacaatgaggagcctacaacatgtttgaatgctgcactgaaagaaatgaatgctaatttgcccacattgaaacgtgaagacatactggcatcattcttcaataaatttgaagttctttttgagatctttacaaatgaaggtaacttatatttccccctcctctcctgttgtaagtggccacatgttcaaggcttcaaccacaatgtccttttgatgcatgcccatagacatgcgttttgctgctatttttttttaactcgtgagtgatattgtactgcagtgtataaattttagggtcaaaattgaatagatgtctcaatttctattcttaaattgaatagatgtctcaaaattgaataccatgacattcttaatttctattccaggatttcaggcgcttgaggaacagtactacaattcatggcttcataggtatgtagtgtctcaatgctttggatccccattgtttgattttgtcttgaattttatctgctagcgctgtatatccatgggtcacacaggtaaaaggtggcttcccagactctggcatggcaatcagactgatcacctagatatatccatgaacaccctagtatcttttactgctaattgagtcatttgccatatgaaacttgtgtgtgagaatggttgatggaaaatatttggaaaaatgttgaatcttttgagaatcaccttgcatgtcatatattttctacatgtgattcgatattactgaggcagatcttcgctgatatgcagtggacagaaggtcgttgtgcaggatgggcctgaagcccagcatgcagacagtgtggttactattcaggttaacaccgaatttaggaattatgattaaaatagacattttcagttctctgaccattctgttctttttcaggggttgacaccagctgggtacttgtatgctattggcgaggatggcaaaagctatgagttgcaccctgatggaaacaggtattgtcttgttatccatcgctaatatcctcctcatgtgctaatcttagtatccatatactataaacttctcttctgatttctgttgtcaacaatgtaaagcgccacatggtatcagattttttttttcaagagtgacatctgagacaatttcctgcactgcagctttgatttctttgcagggttagtgcgaaggaagatggaaacgtagttctacatgaatacatacataggtagaagagcagtgtacaataatggatagaaggctgctaaaatccacatacttgtaaacatgaggggttgaaatgttttcaactatgtaaattaactttgagaaactgctaccacctttgggtttgctactgctaacatggcgccatcaggcacaagatcaaaataagccttccaattcaaggtgggattaaagaaaagaaaaggagttgacctgttaagtcctgtagagactcaaggaccagaaggagccatgctttgagtgaaatgtttctggctttctgctacccttttgtaagttgtaactttcttgaaacagtgtaacaatgattgatgcaataatatatcatctgagcttgttaacttattgtatccttcaattgttgatggtaaaaactgaaaataagagcgatgactgaattcaccgtactggtgagttaaacttttctaatggcaaaattttaggcctctctggttctgaaaggtatcgtttcaggtgtgcattcatcctgattatgaaaaaggaatgaaagaaaaaaaaaatcttataatcacaacccgtccgcttcacttgcttcgaaaaattaaagaaaataacaattgaaaaacaatatagttcaccagattagaagactcttgtgctgaagtgtcatggatgacgtactccacaactaatctacaaactgccaagtcgcagttgtttgtactcatagacttggttgcgttccttttggcttatagggtgagctacagattttcattcacgaccacttttttcaaactaataaatgatgtattttaagaagtatatagaaaagttttcttaaaaatgatattttttaatttacaaaagttaatatctaattaattatatactaatgactcgtttagtttcacgtgttgctgcagataataaaattggtttttctcaaagacgaagaaagcggtcacaaacatgatcccagagtcagctgtcgcaggacatccctgaacagacagcaagtatttctttatttctttcttttttatttatttatttatttatttatttatttactagtaatataatatataaaaaggcgcccttggctgcagctgcttcacgagtccaactcggctcatcctgctgctccgcccttctcaagatcaccaaggtgagttcctccccctccaaatcttgggagaaagatgggccctttgctttctctcacctccaaatcccctgcttcctgatccgttttcagcagccgcagtagctcggcgagccggcagccgacgggtccaatggcgcaggatgattcggttgtttctgctcagtggctgcatgagcacttagggcagcctgatgttaaggtgaagcagttttcaattttatcatctactccgcatgcaatacttagggccctcagttcagaaatacttttatgcttgaatctttttggcagcattttagaagtagtagcaaactgttcttgattattgtccagtaattagttatgccatgtaagaaggatgtggagtacagtacctactgtttagtgatgatcaatataagaaattattggttgtttgccagtttgattatagtatcttactttcttgcatgttgtttagttttgttgatctgccaaaaaaaaagcattggaagattattgattgatttgttagtaacattcgtccacttgatataggtgctggatgcttcctggtacatgcctgtagagaagagggatccatggcaagaataccaggtttgaggatcagttgtactgaaagtactgaactttgtttctgcttttgtgaaaatgttttctcagctcaagcattctgatttactcaggtggcccatatccctggtgcgctgttcttcgacatagatggcatagttgacctgacaactgatgtgagatgtttcaagatacacctttcattctcatttcacttattgtttgagactttgagttgagtaaataatcagcacaaacatccttgtatgacttgcacttgttaattttgctacaactggaaacttattctttcaattaatcaaaattttcttactgtatgaagtttttctgtccttttttaaggcatggcatataaatttagatatgtgatatatctttacttcatgaatttgtgtcagttgccacacatgctgccatcacaagaggcttttgcagccgcagtttctgcgctcgatataaaaaaccatgataaagttattgtttatgatggaaagggatttttcagtgcacctcgtgtatggtggtaagcacaaaactgtgattttttaatactgcgacaatgaagttgacagaatccacagcctttgttttacttaaattaatatgttcaacatgacaattttatctttgtatactcttatcaatcaacaggatgttcagagtttatggacacaataaaatttgggtgttagatggaggtttacctcagtggcgaacttctggatttgttcttgagagtagcacccctggtgatgcagttcagaaaactaaagctgctaacagtgttgttgaaaggatttataatggtcaactggtaagctggctataaatacggtctaactatgcatcatgcaaactgtttttaacttattgaagatttatggattcatttttcaggcaagtgatgtaacatttcagactgaatttcagcctcatatattctggacactagaaaaggtcagcctttccttttataactgaaaactttatagagttatgaatgaacatgaccatgaactcacgcgatgtgtttctttctatagtggtctccaactctaaactttaggtttcatgatcttaaatttaacctcgttaaaagttgtgttactttaaccataaggaaatgaagatgactgtcaggactctgaaaccttgattatccctgtgtgttgggctgtttttgttttgaacaggttaaacataacatggatgcacagtctcaccaagtcgttgatgcccgatcaaagggcaggtaagttctcctaatctttagtacttagattgcaatatctatttatagaagttctaacgataactataaggtgctagtatgtaaagtgccaatcaaatatgattacttatctctgtattagtagaataagtagtaatagataccttgacagcagtttattacttcgtgaagaaaatcacttgcacatcgtttgcagatttgatggtgtagcaccagaaccacgggaaggagtaagaagtggacatatcccagggacaaaatgtgttccattccttgaggttggttataatgcaaatatgcaacatatcacatggtatttgggtagtcacagacttctaaaaactggcttcattgatcttgttacagatgtttgatgatgcaccaatgcttctccctgcagatgagatccgtaaaaagtttgagcaagcaggttcgaaactctgattcatctcactatccaaaaaaaatgtagtttggccaatgtacacatgaaaagtagaacagatatttcaacaaatcaacagtgtagattttcttactcaagagatgatatttcttagggatacgaggatactatagctgtagaattatgaaaatttcaccgagcaaaaaccaatgacaaacactcgtttgacgtttctgcagggatatcccttgatcgccccattgtagtcacttgtggatctggtgtaactgcctgcatacttgctttggtttgaaacattacctgctcatcttagattgtgccatttggttgtaaagcactctaacaactatcactttacagggactctatagaattgggaagcaagatattccagtttatgatggatcttggacagaatgggaagctctaccggatcatgattatccaaaagttacctccaatggttcttaaaatcatcagctccgaaatgatggattcatctgctgcatttttcaccattcagtttagattgtcagctggactgtgttctctttgacatgcttagcgtttgaatcaaaaggaagcggaaatgtgcactcttggcaattttgatgaggccatattcaatattaaacttagatcgatgatgtactgaatgttatcgttaaacaataataagcataccaattgattttatatcagaatgacaaactgtgttgtcactacattatttttttttattagttatgtgctctgtaacagtgcaataaaatgaatttgtttaccacaagtgcaagtccgcaacctagtacctcaggtagcaattcgttttacataaatataaataaaatgattaataattgctcaactgagcaaatgatatttgtactaggtacagaagataaaaatctctgctccccagtacaagttgagtggcagtacaaagttatcgtcctttgctataagacaaatactctctactcagcaagtttttggctaattattagtcagcccatgctcatggatgcaaagaaaaatggctcaattctagacccttttatttattcttcaattgaagttttgaactgacaagctatttcatttcatccaatggcccatccagataaatttagctttactgtcatatattggggctggaatctctttgcatttccaaaatccagaggctctccacccatcaggattcaacacttagcagccatatgacaaacatgaacagatcatgtaatgtccctttgcgcctaatctgcaacatatatcattttgccttccagattcttccacagatcattcagacgcccccctgaccacattacaagaatgaatcctcgaaggctctcaagcaaatggcaccaaagtggcacaactggattcagcaaccatttgcttagatttatcagtgcattttgagtatttgacagcagaaaatccacatgttgaatcagccgacacaattctcatcttggtgtacctgaggaatgctatcttcgttgctaaacatggtgagttctccaccatctgctccaagatcatcagcaaccataaaggcacgaacaccatccttctgatctatccagctatatccacgacctttgacaactccacgattactcatcaatgccctaacagccgatgcatccccatgtcggcccaaagacgcatatatatttgacagaagtacataaggagatgggtttttaggatcaattcggaacaggtgctccgcagcacatttccccaattcagcattgtgatgtacaacacatgcagcaagtagaacttcccagattataggatcatctttgcatggcattttatgtatcagggcctccacttctacaaagcggccagctcttcccagtgcatctatgagacaagtgtagtgctcagccaatggtataatcccataactgttctccatggaattaaagaatgccattgctttgtctacgagcccggagtgactacatcctgttaagacggcgatgaaagtgacagcgtctggcttctgctctgtagttagcatatactcaaataattcaactgctttgtctccaagaccattctgagcatatccatgtatcatctcattccaagcaactatgtttttcatcatcatggtgtcaaagaaaagacgcgcatcatccatgttaccacatttagcatacatatcgataagcgcactgcccacatagacattctgatcataaccatctttcataacctgagcatgtatctgcctgccgtgaggtatagaagacaatctagaacacgagtttatcatactagcatatgaagattctgttggcatgatcccattttccctcatctgcttgaagaaatcgaaggcctctttattcaaggaatggatagtcaagcctgagatgatggaattccagcaaaccacatctctctcggtcatcttattgaaaatgctcctagcaataccaatctgaccacatttcgaatacatatcgaccagaccactagcaacaaacatgtcgttgtgaagcaggaatcttactgaagcagaatgcacctgcctgccaaaatccaaaattcctaatttagagcatgagctgaggatcacggccaaagtagtccggtcaggctgcacattttgatgctgcatccttctaaacaactcaattgtatcttgatgctgttcctcctggcagtatcctgacaaaagtgtgttccatgtcgtcacacttggccttgatatcttgtcgaacattgcacgagcagaatgaacatcccttgccttaatacaggaagcaagcaagttactgtaagtgacctcattgggctcaaagccagcctcttgcatcaggctaagtacctccactgcctttgcacagctaccctcttgaccaaatccagttataaggatgttccaagacacaatagtgacactgggcaacgactcgaaaaccttgacagcctcatccatctccacgcacttcgtgtacatatcgatcaacgagttccccacatgttggtctgatccaaacccttttctgacaactaatgcatgaatggcctgtcctagccggaatgctcgagcaacgctgtaatcagtagcgcaagcttgcgcgcaggcgccaagaacactagagacagacacgggatcaacaggaaccccgctcctgcacatcctcgcgaacagcctcagcgcgtcgtcgatggaccccgtctgcgccagcccacccatcatcgccgtgaacgacacctcgttcgggcgagccattccgtagaacagcctcaccgcgtcgccaacgctcccacacttggtgtacatgcccaggagcgcgttctccacgaactggttggcgtcgagcccgaccttcaccgccaccccgtggcaccgcctcccgtcgccgagcgcggcaaggccaccgcacgcgctgagcacgctggcgagcgtgaagtgcgtggggagcagcccctcggcgcgcatccgcccgtacatctccaccgcctccccgccgtcaccgggcgaccgcgccagcgcggagatgacggtgttccacgacacggcgttccggcgcggcattccgccgagcaggtcacgggcggcgtcgaggtcccccgcgcggcacgccgcggagagcgcggcgttgtaggagtagtcgttggggctgggcagcgcgcggaaggcgaggagcgcgtggcgcgggaggcccgcgcgggagtagagctcgacgaggcggttggcgaggaaggtgtcggcggcgaggccggcggcgagggcgcgcgcgtgggcggccttggcgtgggcgcggctgggcttggggctccgcttgatgcaggcctccaccacgccggctagctgggccgccgcgctcgccatcttccctgtctctcaaccgcgcgggaaattcacgagcaacgacgtcttttatagtggccgggagtagctgggccgtgagatgggcctaaggttgatttgggctcacattttagaggcctctgtttcatcgtgcaccagtgggccgtcaaaattcgtcaacttctcttctttttttttgagaaaatccctttgtgtacccactaatccgttccatgccctcaaatcatacttgatcccttctgacttgtgtacccaaaattttgcttcaatctactctctctgtttcatgttataaaactttctaatattatccacatttatatatatgttaatgaatctaggcacacatatatgtctagattcattaacatatatatgaatgtgggcaatgctaacaagtcttataatataaaatggaggaagtagtttctttctaatacggtgtattaaggtttttttttggttggacgttcatgtctaaatacgctgtagtagtaaacgtcccatccaattctagatttatatattctgggatagaaggagtaccatataattgtttccaaatttacctaatattagatgctcattttttttatcaaactttaaaaagaataatgttaccatactttttttagccattaacatatggtgcctagaggagatcttgttacaactatgattgtttaagttggttaaactgttgtctgaacttagacgtgacaaaatgcgacttgtttgtaagtgacaaacaaaacaaacaaccctgatgctaacggtggtaaacgaccaacttctcatgtccttgtacatttgatattcatagtagtagcatattcttgagaaaaaaaccatgacttttgtgaacacatgttccgttggtaaaattgcatacctacgctacgtgagcgcatgagttctactccctctatctaaaaatataagaaattttatgtgggcattggacgcatcttaatattacgaatctagacagacttccaaccactacgattaaaaaagaaaaaggttcttaaaaaaaatgtgggcgcattaattcgacctgtactaacaaacctaaaaaagaaacaaatgtttatgaccagatacagcaaatcctaggtactgtaactactagtagcagatagatttgccgggtgttagatccgatcgagaagaacaaacagttacagctagcccatggattagatctccgatgataaatcctaatcttaatgcagcaaccatgatccatccagttcatcagttggtgcttttcatgaggcacacacgtgatggtcatggtcctcatggaccagcaggagcagtgtatcagtggatgcacacatgtgaacagagccaacagcaagaacagatctatccacttcgcttaaacatgattagccacttacttttgcttttcaattaagaggcaagatgaactgatgttcactgataacaatgtatgatctgatctgaacttatgacaacagttttgtcatcattaaccaggattatcaatagaatgcgaccatatccggcaagaaattaattaaggcttctaattaagttgtaatctgtttttaattactgattaataatgactttgatgtcagtcggtcaatgtggctgcaactactaccgtgatggggagatgagaacaagaagatggatagatgcagcagtttgttgggaagaagctgtcgaaagcgaaataccatctgctgctgctgataagggtcataactttgcatgcgtttcatggcccaagtttcagctgtgtgtggtcctcttttcatttttcagacaaatgtaactgtctctggtcctgcttgtttgtagctagatctgtactggtgttcactggcttaattatttggcaaaccagctaatacttgcatgaattttggcggaatttatatcagccacgtacgacaggggtattctgaatttgtggtggaattgctgagcagagtgaacttaatttcacactgaaatttaaggtactgtttttctgttcactatctatttattccttacaggaagaatttatagtttgtaaccatgaaacacaacctatttatttagcctcgtatgtattctggatctgtgatagaattggtgaccattaagtacaacaggcggatgattattcaaacgattaaaaaaaaggttcaactaatcgctaaatacagagttccgacgtccagaaaaaaaaagatcgtatcgcgttaatgaaacggttttgttattgtcaccgtatacaagaatgtagcaatacattactccctccattaaaaaaaaacacaatcttgagtttaaatttggatatacactatgttcagattcaagcttagaattgagtttttttttttacggagcgagtataacctactttaatgaaaaaagtccttgatgaattaataaactcatttatctccctccagaaaaaaaaggggttaaaatcgaaagcccacatcaggtttaggctacatacaccagtgtacagtccactatacacccacccggtaaaaccacccccctctcaccgcccaaaacaaaattccaaaatcacctcctccccaaaaccgaattttaaatttgaatcccggtaatctcaccgccacattcccctcacccaccctttcccaataaaattccccacctccccccctccccacgcttcccaccccccaaatcctcctccctccctcccctaaacctcgccggaatccaacccctccgccgccgccatgagggagatcctgcacatccagggggggcaatgcgggaaccagatcggggccaagttctgggaggtgatctgcgacgagcacgggatcgaccacaccggcaagtactcgggcgactccgacctccagctcgagcggatcaacgtctactacaacgaggccagcggcggcaggttcgttccgcgcgccgtgctcatggacctcgagccgggcaccatggactcggtgcgctccggtcccttcggccagatcttccgccccgacaacttcgtcttcggccagtccggcgccggcaacaactgggccaaggggcactacaccgagggcgccgagctcatcgactccgtcctcgacgtcgtccgcaaggaggccgagaactgcgactgcctccaaggtattttgctagatctgctcgttttgtttggaatggtgggagattgggtgttgctttgctgcattccgcgtgtagatcttgtgttccatgcttgtcgtagcgcgaatggtgggggaatgctgcgattctagggttcttagctcgtagatctggccatttttttttactgaacatgtagatctgtgtgtttcactgcgcaatccattcgtggtgtagttggggaggagatgttccaactgctgagatgtggtgattagcacagtaggtgtggtggttgtcaacaaccttgttaagcctttcctcgtgtagtacttaagatgtggtagatccggcacaatttcatttatcattgtatgcttgattggttggtttgttgccttgcttagctgcaaatgtggaactctacattcccctgacttgtagtaaactgtaatttttcgcgagttgttgaaggcattttaattcgaactgacacttttacacttgcaagtgtaactgcaagctactaaaatggtagtagaatctaggggctgtaattcaagttttacctttgagcccagcttatcttaaggttgtttctggtgcaatactctgatatttgctagaatgatagatgcagttaggaaaataatgcagcatattgttgtttagttctactgaataggtatgctatgtggtttctgtcacattcacacatcagtagttcacttggtggtgccttaagtgaagcgcttatgattcacgctgatgtgttgcagtttgtgttcaacatcaactgaatattgggtaggaattaatgtatgtgctccatttgccacaggatttcaagtctgccactctctaggaggaggaactggttctggtatgggtaccctgctcatctcaaagatcagggaggagtacccggacaggatgatgttgacattctcagttttcccctcaccaaaggtttctgataccgtggtggaaccttacaatgccacactatctgtccatcagcttgttgagaatgccgatgagtgcatggtacttgacaatgaagctctatatgacatctgcttccgcactctgaagctcgccacacccacttgtaagtgaaaacatgccataattatggtactgtgctcagttatcgtactctgctctatgttgttattgatcattgatttcatcctggtacatcagagcagtttataatcagtcacctttatgtcagatgccactaccaatttactcttttgtgaagtacggagtataatgaattagctggtccatgttccccattgttgtgtgtttcatgcatcctggcactacttgattcaattaatgagtatgtctggaacttgcattcgaatacactgatactgaatatatagatgataagtctgtactacatgtatggggtctacagtgttgatatgaatatgggtttcttcatgctgttttacctaattctgactctgctttgtttctttccttttgcagttggtgatctgaaccatcttatttctgcaaccatgagtggtgttacatgctgcctgcgcttcccgggacagctgaactctgacctccgcaagctggcggttaacttgatccccttccctcgtctccatttcttcatggtcggctttgcaccgctgacctcgaggggatcccagcagtaccgcgccctcactgtcccggagctgacccagcagatgtgggacgccaagaacatgatgtgcgccgccgaccccaggcacggacgctacctcacggcgtcagccatgttccgcgggaagatgagcaccaaggaggtggacgagcagatgctcaacgtccagaacaagaactcgtcctacttcgtggagtggatcccgaataacgtgaagtcgagcgtgtgcgacatccctcccaacggcctgaagatggcgtccaccttcatcggcaactcgacgtcgatccaggagatgttccgccgcgtgagcgagcagttcacggccatgttcaggaggaaggccttcttgcactggtacaccggggaggggatggacgagatggagttcaccgaggccgagagcaacatgaacgacctggtggccgagtaccagcagtaccaggacgcgacagccgacgacgaggaagaggactacggcgacgaggaggaagacgaggttgctgcctaagccacctacctgcctgccattcctctcgctctcgtcatccatcgtagatgatgattgaggatgtgctcccttgtgttattattacctagtactgtattgcaactgtcgatctgggtcgtaagatgtttattttaggtgatttgatgctctagttactcttttttttccttgtgttgattaatggtgtgttgtcgatgcgaattgtgatactagctttaactgtggacttaaattactagatcctggaattgatactgtttgccagtaatatcgtgtgttgcgtgatcattattttttccactacgaatacactgcgatgtcattagtgggcgtgtgctaggatgtaaacgtggatgcagttgttctaagcctccgtggtttgcttgttatctatcttatacagccaaaatttgaaatctggaacttaattttaagttaattttggggttcattcatctttcatttcccatatcgacttttaaaatacaatggcatgtgtatataagttgtgcccataaattactttggggtgcttagttcatttcccacggctgatgagccgtagatggaacaatcagagctgcaacttttgtagtattcgttttctgagccctaaatagctataatacttatacttgtttggtttgttttatagataatggaatttatttgagacaaatcggagtcagtaatggactttttcaaattttttggattcaagaattgtatcgatgtcccattcgaacaggcatcaaagtcgttgtagtatagtggtgagtattcccgcctgtcacgcaggtgtgacccgggttcgatccccggcaacggcgtttccattttttttaatatgaacgcgtctagtccgaatcgaattttggtcgggtacatatattttttacaccgatcgattcataccaacgatcgatcctacattgacaagttccaatgttgcgttgctccggcgaatcagatcatcgtcgactaatggccggtaccggcggcggcaaccagcagcgtcaacgacagtatggacggctacctgcttagtagtgtagtgttctggaaaaacattccaaatggtaacaatttttttgccaatgccaacaaagattagcttcaaacaaaatggttgccaaattttggtatggttgagaatggaaacaaaccaaattttggtatggttgagaaatatcacaaacatcgatatttaatagtcatacgacaagagctctcaataatttaaaattttaatcatactatatgccaggatcaagtctgctcaacacaagcacaatcaagtgatgcagggacaaataccacgagtaaaacattactacatcgacattacaacaaaaattggcaatacagctcaagacatctccctgaatcttgccatagccttcttctggatgatggttttgtagctatcaccagcttgcgcctccagcgacgggtcagaagatttccgctgctgacttccaagtccagccctcacatcgacagatttagcctgcactggttccttgatgccactaccagtttttccgagaccctgaatatttgcgaaggaatagcaagcaaaagagattgccaatgtatactcaagtcagagaatattcgatttacacagcttccagactgaggaaatattggcaaattgattcttctgcagtcacagttaacttctcttgtctcacaaactactcaagcctactggagctattttccctcaagcattagtgatcagtaatttccacatttattctagccttacgaggtagagccaacaaacacaagtaaatcacaagaaatgatagtttatgggtcaaacaagatgataatataatccactaaatttccttgcgaggaagcctaccagcgagattcgacaatcaataagtcaatacattagctttacccataacagataaagatttgctcaactcagtcacaagtgcaggaaataaaattctacagcctatataatgcaacggcaagcccaatataaaaaacaatgagtggctggacaaacaaaaacggacaccagaaagaattattcaaatacaggcagcagcaaggaaagccatcaaagagtaataaacaaaattagttatagaacgtaccagtccttcttgccaacccatattgcgcagaatacgattgcccacattgctctcatctattgctctatcagcagtgataacctcataattttcagtattgccaatttcaccgctagaacgttcacccacccctggaggaaatggcattgaccccatctcacttggaccccttcgagggtactcaccagcttgacaaggaatatccagataattaatacaagtcgatcaagctatataaagagaaatagccttttattgtgccccctccgattgtgaatacctagttctactacaagtttacaactttatcaatttacgtatatttgtaatctaatgtttccttaaggtcatgccaaaaaatactccactcaactctacccatatcactgcgttttactatcttttagtttgcatgcttgtggtgttattgggagtctctggtcttattttattcaattcatgatgtgctttggtcaaagtgacaagtatctatgagtatattttacaagctaaatagaaagtactgtaatgacaaaaaaagctatgctgtggatggatagtaaactcttgtgctaaacaaatgaggctagaaaataatgtctgtgagagcattcttacttggatccagtccatcattatcacttccaagtgaagaagatgatccatatagatttcgcctttctgcagcccgatctctgtactgtgaatgtcctggagcctcagaaaaccgacgtttaccactccctgaaactccagatggagtataagatgctagagcagataattctgttttgaagggagcagaagtaggtgccccagcatttgctgttaacccacatgtgcttgttggtatgttggagaaagaatcagcaccaccagcatcagatggcgcatgaaatgcagtgtctgatctgactattcctctaccagagcctcttatgacacccataatggtagttcctaaactgttactgacaggtgtaggctttatatcagaatctatcatttctgtgggtgcagctgttcgtccaagagaattatagctagcaggcgagttcatgtccttagcatttccaacatcagatttaggcttagctttcactgcaaatccagttgaattgtgtaaattgtttaatttatcatcagcagagttggatggttccttgtcatcaaggatagcacgccctgcctggccttcttgatttctttgtttccacattgctaggacattattcatctttttcttattcgccaaaagactaccttttgatgccaacttgatctcttttgctctctccttttctttcttttctgcagccagcgctgcacttgcagcagcttgaacagcttcaggtaatgaagttttctcactttgtttaatcgtggctgcaggtgcagaaatcactacatttttaccactactttctgaggtcttcgtgctagtatttgccatgtccccagctgctttactgctgttctgttcactacaagggacatactgttgagtttgttgatcatatgaataccacactccagcattaccatcatagtaaagtcctgaaaacaaatacaaggttataaactgtaatactttaacaattgacatggagcaaacatttttttttaaaaaaaaggaaaattggaaaacatttcaaaaacaagtcacatggaaagtatttctgaattgatcatagtaagaaaattgtggcaatatacataccggtatttccatcataatagaatcctgaggctgaatcatagtaataaccagacttttcatcccaaacaaatccagactgtggagcagagccactgctctgaggttccgagttgctattcagtttgtcatcaggattgtactcttttggggcccaacctatagcatcatactggtccaaagggtaaaagaaataaaataataagcatcatgtctataatctgcataaattgtatgtgaaaaacaattgcaccttaccctacagggtgagaaattattggttttagtgcatcatttaatggagttacataacagcagttctcattttcttcaatgcactgtttactttcctgtgcacatggtgacaaattacaagtaggggctacaactgacctgctgagaaaatgatgcagcctcaatggcagctgcagcaaggctgtttgactgtgaagcccctgataccggtccatgtgtgcttttagcataagttacacgtaaaacctgaccattcttctcaagtgtaatcccattcgtagcttcaagagcttttgtagcttcttccacctaacacaattggatgcagataaatatgggagtagacatcaaaggaaaactcaacatttttcccaccactacttactgaatgaaaatggatgaaagcaaaacctctggacacatgagtaaacttatcccgaacaaggcgaatgtcctgcacaacaacagcatgtcattctctcaacagaaacggaacactgcaaatttcaagagtcataagcttcttcccacctttataggtgcatgcttggcaaattcatatcgaagcatttcctcgtcagcattttcatccagaccacgaacaactaaaacatgagttggacctgaaaatgctagtgtctaataaggcaactggcaaaatagttttaataatcctacaatagaagaacagagctttgcctagttcagatcccctttttggatggagtggagtagaacttgttggatcagctggtagagaatcttccgttcgtggttcattacactacaagaatagaatgcaattaggcaaaaaaaaatcaagagcttaaataaacaaacatacaatcagttagaaagaaatgttattcccctgatgcctttataattgtcatcttggtccttggagatagacaaagtagttttcatgacaaattcactaatggcattttccatgtgacacatcttattattttgtttatatttatactagtggctaatgatccaaacatcatgagttaatccaaaagcttacagtttatgcaattatgacactacttaatttgcaacttctcattaacaatagggatgttgaatcgaaagggaaaacagtactccatcaaggaaatcgaggacagagaaacaatccaagcatgctagattggatttataaacagaaatgacatcatgcaaacttctgtaagacaatactaaatgcaatgggtattgcgatgaagaacacgcctacaaaaataatttacaacaatacagagtaaaacatacctgaaaacatgaagttctgcgagcaaagttcatgcatccacatatagtacatatccaatcacatggcgcagcagcagtcctgtgcccatagttataccttgtaaaattttcttctccatgagaaggcccactcatcccactagttggtttactactgcagtaaacaagttgccagcagtaattacagtggaagaaaaagatataagtatatacttttgcaaaaggtaagatgcatgtaaattgttttttctcaatgtgtccttctgcaaaactaagcttgatgcaagtaatacacactagacaaagacatgaataacatccaaaagaaaggaacgagcaacttaacacactgtgaatctttaacacaccaatggtagattgactgttttgcatcgcaagcttatcacaatataaaaacatttacatgaccttagcaatatgctaccaaaataattagatatttttgtgccctatttggtcagtcatatgctatttggatcattgtattgctaatgcaatcacatagttcaattgaaaaaccttaagtgggaaaatagtgagcagtgaaacaacaaaaggcagagccacacgagaatttggtatatgaaagacatgctccagtgaaaaattactattacatgatgcacccagtttaaacagttcaaccattattgaaccatcgaatatgctgcaattgtgttgttcacacctcagtatcacgtaaagcagactactcaacaatgttacatacaagtaaactggtgaataaatatagacgacttcagctattataagaaaacaaaaagggcacgtacctgtactgaaaaaatacctttctaccatcaattagaaggccattgtctccaacaccttccatcattctgcgggcagcttcctgtagagtacaataaaatttctgagcatgacactacacgacggtctgaacaggtaaggtgatagatcttttacggttaataccacagtagggaagtcgataaaagcaaatccccgagacatgccagaagatcgttccttaattacgcgcacactacggagagggccccactcagcctaaaagatatcagactccaaatgattaaatcgaaccagacaatacacttgcaaccagtttaacagtttatgaagaggaacttgtacaagaatctggtttaggtcatcttcattagtcttctgggacagacccttaacaacaacagtagcagatggagcctacaagcatgaatggaaatgttatttgattcatcagttcaaaacacatttgaagcatgcaattatgtacaaaacaaaggaatgaccataccactaaatctccatgccttctctcatcccagtcatactcccttcttctgccaaaggaattgtcatcataaaagccatctctttggttccgaccacgacttttgccacggggtgatcttgatctagaccgagatcttgatcgttcgtcacgcccacgagatcgtgaacggctatgttgcatgtatggacttctgtctctttcatgactcaaccctcttctttcatgttcactctcacataaatcacgccttctccagctaccatctctcctgcttttctcatagtccgaatcatagctgtaacgatcataatcacgatctctctcatagctatcctctctactatcctctctactttggtgagagctgcggtaccggtcttcaaagtcaccgtgaaactccgcacggtctctactcccaatccttttgttcctatcaaaacaaaaatcacggtaactaccagattcatagttatcagcagcataattatcgtggagtatatcaactcctccataggattcaaattcatgatgctttccatcattgcaatgataagtgtcatgccttctgtaatctctagcagttgaatattcatcatcatgaaaccttcgaggttgagacaacatggggacagagggtgcaggtggatacacatttctatcatgtgtgtcctgatagaatgccccccttccatatgaatctcctgggaagccatcatccacaaacctcctaccattgtaggatccaccggccctgcaatttgagtcaattgtagaaaatatggtaatatgacagagcacattaaagtggacaacatgtcataatggaaaaaaatattgcaactactcccaataaattatagctgagcacacttcaaaagtaagtcgaatagaatggaagatgtgcatgactacaaccgctaacaatctaacataccatcacaatagcttattgacttacctataatctgggccattgatgacaccatacccatccaatgcctgtagattcaacagaagttgagtcagcaagtaagtctacagaacaggcatgtaacccattccatttaagcaatggccgcttcttcaaattctttacatcacaatgctggccaaccacatggccagcaaatctgctattccttgttagctaataaagggaaaggcttcaattacactgttgttctcccatccatgctgtggagcataacgcccatgatccatttctgatattcggcactgatgttagactgcaaagttcttggagatcttcagaattttgggtgtagatttttctactgtcctgtaagagatgcatgatatcacaaggttaagcaaatgccaacacgaaaaccaccatactggcacccttctactgcacattcaatcaactaatcaagaggacgttcctttgattgctaatcatctcaatatcaaattccacttttcaagtttcacttttttttatagcaagtgtctgttccccttcttagaaatccctccaccatgtgattagcaattccaagtaataaaccaacttcacaagttacaagattccatattatagccacttggtttacgattttgtacgtagatgggacggtggagaatgaaggggacgatagaaattggactatttggtatatgattttgcatataaaattgtagatttgatagtggacatggaagtgtcagaggtggagccactggacttggcacaatgttgtaaagtcaaatgctgttgcagcaactgcacaggcaccctaaacaaaaactatacttgattcattagatcatgattaaaatctcaataagcctccgaattctaaggtagtaaattacgatatgccatggcttagaattcacatacacacaggcagcagcagcacaaagtcaaactatcatgacaccatccagaatctctaggttacccccaagaaatcggcaaaattttaaatcgccagaagttaatccactagggcgattcccacgacacctccgcaaaacacaaatcgaagacgaacacgaggtatcctgacccgtcgcaccctcatcctcctctcctactaccactttacctctcgattccgcgtgaggtcgccggcgtagcggggaccaggcggccgtcggggcacacggggccgaaaccctagcgcgaatcgcgatccgcgattcgcgcgcaggaccaaaagtaatcctcctcccgccgacggcgctcgggcgagcgaaggaggaggctagggtttccgcggcgggcgcgcgtggcgttcgatcggcggggggaggaatcgcggcggcgcgtggcggcggcggcggagcagtggtggcgttgcgtgcggctttgagctgtcgcgactcgcggacgctttggtcgttagcgtcttagcgagagagggcgaggacgttggagagggaagttagaggcccagtgagcttctctgttgggctatgtgggccgtggcccaatgctcctaacgcccaaacgaatacgagatcgatttattatttcctcggtcctattttttgcgcgattgctaatcggcgcgcgtttccggcccataaggcccagcgccggcgcgcgcacgcctcccactctttttttttgtttttctttacccattttttttcgcattttcctttttttctgattatttttttaatctttagcatgttttgagtttgaaagttttaaattttgagttgaaaattttcaaatctggactagaaagtttttaaatctcgagttgaaagttttcaaatctcgatttgaaagttttcaaaattttcaaatctggacttgaaagttttcgaatctcgagttgaaagttttcaaatcttgatttgaaagttttcaaaattttcaaatctggacttgaaagttttagaatcttgagttgaaagttttcaaatcttaaattgaaagttttcaaaattttcaaatctggacttgaaagttttcgaatcttgagttgaaagttttcatttctgagttgaaagttttcaaaatttaactttaaattttaaaatttaaatcgaaaattttcaaatctaacataaaatttttttaatctgttagtaaaaaaatctcccgaatcttttctaattactatcattagtgttaagtatattaactaatagaggtaattaagtatattaactaatagtgttaatagaggtagttaataggggaggagtgctcgctagcagcgagcacgcgttagctaggagccccctatttttttgggactattttatcaaatctttcgatggagagcttcaaatcttacaggatttttaactaatagatgcatatctttgtgaatgaaataaaacaaaaaaaaagacaaatatatcaaaaatcgtcaatctagagaaaaaatattgttgtaaaatctaattttgatatacatcgtaagtgagtgcaagtgctctgtaactgagtgtaactgcaagttagatttatagaaatataaatcttgatgcaatatcatatacggataaaaaaaacgaaagatagaagtccaaaatctgtcaaaagtgaaatagcaaaaccgtaaaaaagaaaaaaaactcttcgattatatggaagatacgtacactcacattccatgagtacgtcctctactcatactagcataagaccattacagttcgactagctatgatagatcttgtgtgaattgtgatgccaatacctttcttgcagaaatctctccaatttggaacaatgttatagcaacatttgcagcatgtattaaaggagaaaatacagttatccatcatcactagattaatttttccagcccagtcggtacatgtcccttcacagtcacaggtgaatggaccaagagtgagactgtgagagctagccggtgtctccatcatcagtggaaaaaggatcgagcagatgtcgacggaaggtaaattctacacggtttgtagaagacgatggccgcctacgctttcactcgacgtcgacgccacagaatacgtacatatagactatgtttagttcacgctaaaattgaaagattggttgaaattaaaacgatgtgataaaaaaattggaagtatatgtgtataggaaagttttgatatgatggaaaagttgaaagtttgaagaaatattttgaaaactaaacacggcgattacctacgtacggcacagagacggcaagacacgtatagatgatgtatatttatacgcgctggtaaaaattaacccaaccacaattaattcgatttgacgaccaaaaaaaatcgccctctgctatcgttgtcagcagaaaggaaaaataaatttggtttcagaaaaaaaagaaattaaaaaaaaaggcagctgctagctactcctacctagcaggtgtagaaattaaagaatcgatcgattgatcgaggagatcttctagaagactctggaggggaaattaacaagaggacggcaccgtagaaagcgaagcttttgacgaccattattctcgcgtgctagctagctcttcacacgtacggtacaaacaccgtgtaaaatattgtggcatcgagatacaacgccacgcaaatcgatgccttcaatttactgaatcatccataattttaattagcgtcgttataaacaccagaaatacttcacctacgaaaaactatttggcagttccgcggttgataggtttcgtatgtgcatggctgtcagttcatctcaatatcgcaaatgtagaggttaatttggtgaggtctataaatttactaaggggctattcaggtcgtaaccaaaataaaccttacgaaattttggcaacaccgaaaatttggcaagttgtcaatattgtcaaaattttagcatgatttcttatgtatttatctaagtttaacaaaaaaaataaatttagacacttgtttttttatataattttgtaaaaaaaacagtatgcttgaaaataacatcaatctgaacagccctaagcaacttttaatatcgatatgtttatatggctaagatagaagggacacttagtatacatgcaggcatgcttgattgccatttaattagattaggggattgctataagggtggatctggattgtgagtatgggaaatcggagtggttgaaggtaggggtggaaacgagccaaaccgagctaagctcggctcggctcgtgaaagcttgatcaagaacaggcttagcttggctcggcttgataaatggaacgagcaaaaagtgcagctcggcttggcttgtataaaagcttgagccggctcgagccggcttgcgatgtaagcaacaagtagggccggcgacgcaggggacgtcgagctcgagcggcactggggagggaggccagaggcaacgtaggggagggaggcggtgccgcggcggcacgaagcgtcgagccgttgatcgtcaagtgtcgcttgggagggaggccggagccggcgcagccgcacagaggagggatgcggtgggccggcggcaccgaggggcgactagggactggggagggagacggcgggccggcggcgcaggggagggagccggaggcggcggccggcaactcctctcgccaatcgccgccagacgctagtcgtgcgcgcgagcggcggcgtgcctgcgcctgcgtgggatggggaatggggagggtcagcgagcggttagggtagggtagggttctctgtttctcatgggctagactgaaacaacttgttaatgggccaggtcaggacatgtactcatgttttccacaggcttgacgagcctactgtgcggcttgcgagctagctcgggctcggctcgatttgcaaacgagctgtggagagagctcgggctcggctcgtttaatcttcgagccgagccgagcttcacgagctcgagccaagcccgagccgagctcacgagcccgagctttttgtccacccctagttgaaggtgagagcatcttagatatatggcgctagctatcaaagacttggaatacgttgagctagctgccacctagcccaacaatattgatagtttggaatatgtattttggaatacatgtcggtgagggagaagagaacgatggttactgtagtgtaagcaaagatcttaacataatttggactgtccaaaagttattgaaatttatggataatttttagtatctagaaactaaaccatctcataagaatatgctaatttgacaagacaattacagttaactagttaaggcggcataaaattaaggtatatatcacgctagaagcagctagttgatcgaagtttgcagtaaaatatgcatactcgtcgtttaattaagcgggaccgtaccataactaacaacacctttttaattaaggtccgatgtctagattagcagttagtttattcgtgagttaatttaatcgcaagacatagtccattctagtagactccgagtcaaaaagatcgggatgtgagtaggagaaaagcacaacgtgcctttcagcagatagcttttgaaaaacaaacagcgaactgatcatagtacgccattaaaataacacccgtgtttgaaatatctcacgcatgatgcatccgagctaattaattgatcgtctagtcctattcttgctcctgatcctagacgttaattaatttacaaggaactattacatgttgcatgctaaaatttggagtccatatatagttatacatatatttacccatttcagatgaagatttataatatacttagataaatatattttttagatatattagtcttagcttttgccctccattaatttgttgaaattgtttagtttatctttgttgagagaacgtccgttgtaacaagcgattgaagcttgtttgaagcaaatatcataattcattccattatcttaaaaagaaatttacagtgtttgaaaacatacttatactaaaattatatactaattaaagattttgatactttaaaatacctcgtgcctggtactatcaaattttatattagaaaatactctctcccgtcccgaccttctcaaggataatcatattctaaaaggaagattaattattttttttccttttatatatagctgtcgtcaaattaaagttatgttgttcttggtgacaaccgaaagatatgcatatatggtttgatgtatcgagatcaaaagtcgtgctttcttgcgtgtggccgacgggtcgctttcgtggcatgcaatagtaccatattatagtatgctgcaacttgaccaccgtgcagtattcgtacgcgtaggtacggtatggtagtagctagtggtacggaaagatgagccaaacggtcctaacaatccagtagtatcatctttttttttcacttttctttttcttttcatcaagaaagaaaaaaggaaagcatgggaagatatgataaagattggagagcatgagatatgatatgcgatccaggcatgcaccaaagtggagcagtagtaacaactaccgttaaattttaaatcccaaataggtctacaattcacaagtttgactcgtgcgtggttaattatatatacaggacacttttatatttcacaaagtatatttccatactattctttttcaattacatgcacgtgcacatgcatacccgcacacttttaaggttgctcgtttggtaattagctttaccaacttatacccctcatcttttacgcgtacgtcgctttttaaacggctaaacgtgtgtatttttttaaaaaaaatatttataaaagttgctttaaaaaatcatagtaatatattttttaagttagttttagttgatacttgattaatcatgcgctaatgatttgttttgtttttttccggaggagaaggttcccaactcaggacaacaacgcaacctaagttcagccttttaacacacgtttagtacgtataagtaggtcatcgatcaggaataaattcagaaagcatcatacgacagttctatcttcaaaccaaaacaaaacctattacgaagcttcgtgcgattgacacaactcgaggagcttacacatgtacgagtggtgatatatttaaccaggccggcatgactaagactaatgcaagaacggagagaaaattacattggtcaaagtaattgactcttaatacttcatccgtttcaaaatgtttaacaccgttgacttattaccacatgtttgaccgtttgtcttattcaaaaacttttgtgaaatatgtaaaattatatgcctacataagaatgtatttaataatgaatcaaatgataggaaaataattaataattacttaaaatttttgaataagacgaacggtcaaacatgtttaaaaaagttaacggcgtcaaatattttgaaacggagggagtaattgttattgctagcaagcacatgtaatgcatgcggcgttgaattttctctcaaaagagtgagaagagatagggtcgtaatacgtgtacaccgtaccgtgattccggacagcacccgtacgcgtgtacggtccacgtggactccaacgacagtgggccgctgacgtcatcgccgtacacgcgtacgtgggaggacaggtaggtactagtacgtactagcagagcagtgtgtgggccccacatgacagtacgtgacaggtcatcgtgacaattaatgcatgtgtgtgccccattttgggttggtgcccttttgctttgctacttgttgtaggttgctgttcatggatcgatgaacaatagcgtgtgtgtgtgtatgcaatgcatggtgcgctccaagtcgatctccaagatgcgtagtactgtacttcattgcgtgccgtaggaatccaattatcttgttatcttttagcccttttgatcttgttgtcacaaagcatcgatatgtggctgagaaagcaaagtatgtactgtgatctttatgagcaatttgcctataaaaagttgtttttttatataaaaaaaatcctacacacatagtataactatagcttcacggattttcaaatggtgtcattcttgcaaacgcattgtatgattgtatttatgagaagactttcttaaatcatgtttataattttatacgatttgttcgcttgcacactcgaatgatgatcactaataactaagggtaagttttaaatagctacttgaagcgactacatcacaatttcttgatgaatacatttcccaaactgttaagtgatacatttcgtgcaaaagttttttacatataagttaataaatatatttttctaaatttattataattaatactcgactaattaccatatagaaataacttactctctatgtcctaaaatatagcaatcttatactggatgggacaagtgcaaagaatctagacatgagtatgtctagatttattgtactaggatgtgtcctatccagtaaaggttgctatattttgcgacggagggatatcttattttacatgctttcaaaaatctaagctaatcatctgttccgaaccaactaaattttttagccattcggcatgcacaaaagagcgagatgtaagaggcaatagatcatagttccactagaaacatcttaaaatttgagagatcgatcgaaaacgagtacacccatatgcacgggccgaacagccaacttaagcaaattaatgcgccgtgacggtggtggatattcgatcgctaccctctctaccaagttgcatttcattgcatcgcatatggcccatacattcatacatgcaaactatagctagctagatatatatactccatctcaaatataatctcgtgtccacgcgcgtgcgtgtgtactgttcagtaacgcgggagtacggctcttaattttagctaggcaggcaggcaggcacatggccgaccgatcgacatgggacccacccacactgcacactgtcattagagacttgttttagggaatttaagactttgagaaatactcccgcctccctaccaaaatataagagattataggtgattgtgacatatcctaagactataaatctggacagatatcttaggatggacaaatgtcagatccatagtcttggaatatatcacatacccataatcccttatatttagggatgaagggagtagctgttagttagtttctgatcaaaatccgaaaaaatagggtttttatcagcttgtatataactttttaaatgtgaaaaaaatgtattgtttaggggaatttctagttctaagataaagtatagttgtcagaagctcttccgaatagatcctagattgccggtcgatgggtcccaccgaccatccactcacaaactaaaccaaccgatcagaaattaaagccaacaacggtgaccggccggcacgcagctaagctagctagcgtgcgacgacggtggtaaaacagccgttgccggtggtgacttcgatcgccgtttaaagattgttgtttccaggaagctgtgtatgctgctgcattcatctacgacgaagaaccaattctacgtacttctatacatactactatatatactaatcttggctgcaggagtcgttttctacccgcgtagctagtctactttgactcggaaaaatacttaaatttagacttgttgcctatatatatatgtgtgtgtgtgtggcatgcacgcatatatacatcaagctgcctcattttctatatatcagtctttcttgacctggactagccttttgcatgcatcctttttgttataaacacacaatactacaaacacaagcggtatgataacctaatgactgaaccgacatcttttgggattgataaaatcatcacggacaacttactgtcgacgagtatattgctaacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactatctttagtcccggttcgaatgctgtcaggacctgtcaggcccccccgggatctttagtcccggttggtagcaccaaccaggactaaagatcttaactttagtcccggttggtaataccaaccgggactaaagatcccggtgatctttagccccggttggtgctaccaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgttaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaagaggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcatcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcatgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaagcagaagaagttcacaaacctaaagtctcatgactgtcacgtgttgatgacacaactgctaccagttgtaataaggagtatccttccagacaatgtccgggcaacaataacaaagctatgtgcattcatgaacgcaatttcgcagaaggtcatcgatccggatagattagaagcccttcagaatgaagtggtgcaatatctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtaactccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatttgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatatgaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagccaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatatctttagtcccggttgttgagaacaaccggaagtaaatatcttttctttactcccggttgttctcaacaaccgggagtaaagatccaggggtatatatattcccggtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgctgcatctctggggtgagagccgccgccgccagatctcccttcatgcagctcgatctctccgatctcgatctctctccgtcgcgccgcccgccacgagacgccgcgccacgacgacgacacgccacgccgccgccttcgacgccgcgcaacgccgccgccgcatgccaacgccacgccgccgccgccgtcgccacgccgccgccgccttcgccgccgcgcgcgcaatgccgccgccgccacgccacgccgccgccgccacgccacgccacgccaccgccgccacggccccacaacgccacgccgccgccgccgtcgccacgccgccgcgccaaccgccgccccaatgccgccacaccgccgttaacgaacgagaacgagaacgatcgaacgaacgagagcgagaacgaacacgtcaacgtacgttgccgcgacaacgtgaacgagaacgagaacgatcgaacgaacgagagcgagaacgagaacgatcgaacgaagacaagcaagaacgagggaacgaacgtgaatgagaacaaacgaacgaacgtgaatgagaacgagcgaacgaacgtgaacgagctagggaacgtgaacgagcgaacgaacgaggacgaacgttaacgtgaaatgcaatatatatatatatatatatatatatatatatatatatatatatatatatatatatatatatatatatatatatatatatatgtatatatatatatatgtatatatatatgtatatatatgtatatatgtatgtatatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagatttagtatataattatttactagctagggttgtataatatacgtcacatagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactaggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccaaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacacatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaatgaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccaccgcaggctccagcatcgactcctcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattacacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcaacttggagggcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtatgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacaccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcaaactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccatcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcatagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatgtatatatatatatatatatgtatatatatatatatatatatatatatatatatatgtatatatatatatatatatatatatatatatatatatatatatatatatgtaaaccatgcagcaacaggggcatgcaaaaaaaaaaggtcagctctatctttagtcccggttggtaacaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgtaatcactaaaaataattagccgtaattgagagcactcatactaagtggttaatgttgaacttggatgtgcaggttccatccctagaaacctaatatgttgggctacgttcactctgtcttttgtatgtgttatggtgaaccaattggccgcatatgaacgtgggggtgagattggttgcaacttgatatactgaaacaaatgctagatgtaccgactatctaaaaacttctacatgcatgtgtgggaggttcaggcaagctcgtgcatattagggcccgttctttaattcctactattatggtagcaaaattattgtgagcatgttttctaagctactaaacgatacaatttgttataaaatatttcttcatcaacatttgttataatagttatttaattcatttgtgcctaaataactatgcatgataagctctagttctcccaccatccataatctatcagtgatggctctttagcacaaatatatatacatatccctcgtgaccacgatcgatgatcgacaatacgatttagacactgcttaattgcgcaggttgtcccccggacgctgaaataatttcagccacaccaatttaatgatggcataattaaaaggagtatatgtgaatatgtgacaaacactcctacttcaattaatcctccagtcatgaccgtgcatatactttttcctggtttatcgcttagaaaagaagacagccagaactcgagccaaaagatcttcaggctcagggcaacgtacacgtacactattgtacgtgcaggtacaagtagatatatgtgacttgctagctaggacaagtagctattagtattaataaactttcaatgtctcctactaattcatacatacgtggaaggaccaccaatccactattcacctcttcccataatataaaggattttaggtaaatgtgacacatcctagtacagtgaatatggacggaccgtctatccaaattcaatgtaatgggatgtgtcatatccacccaaaatcccttatattatgagacggagcgagtatatgtttgggcatcgatcgagcaatataactatccatcaattatttatatggagatggtgatcgagaagtaatagctacacgtatattatctggttttttctcggttgtggtaccaccagcgtatttaactctagaaaaaaaaatataggatatgtgatattactcggtttctcacagcttcataaaatcaattccctatgaaccacaaaaaattttacaacatccaggacttcatactacacacacgtaacgtatagaaaatcaagcagaataacgagaagtccagatgagagacgaaaaaaaatcgccagttcagcccatcacaccaacaaaaaaaatattcgaggcatttacaaatttgccatcagtttttttaatattattaggataccactcggatgacagttctagtggcatttttataattttagtgacaatattgcaataacgattcaaagtagtggcaaatttgcaattgcccaaaaatattctttttgaaaagtaatactctctccatattttaatgtattacgccgttgactttttaatcaacgtttgaccattcgtcttattaaaaaaaattatgtaattatcatttattttattgtggcttgatttatcatcaaatattttttaagtatgacataaatatttttatatttgcacagaaaatttgaataaaacgaatggtcaaacattgttcgaaaaagttaacggtgtcatacagggagttctaggacgtaggagtaataaacaaacaaaggaaaaggaaaattgatttaggggctgtttggtttccagggacttattccaagtccctgtcacatcggatgtttgacactaatttggagtattaaacatatactaattacaaaacccattccataagctttgactaattcgcgagacgaatcttttgagtctaattacgccatgattttgacaatgtgatgctacagtaaacttttgataattatggattaattaggcttaaaaaaatcgtctcgcggattagctctcatttatgaaattaatttttttattagtctatgtttaatactctaaattagcgtccaaacatccgatgtgacatgggctaaaaagttttagtaccatctaaacacccccttagtagcagcactgtagcagcatttccatcggtacggaattccgaggtggggcccgcccatcccccgcagttgcagcgggtgtcgctgtcacgagccagctcgtcccccgcgtccccgctgtcccggtcgccatcggtcggttcgctggcccgccccccagccgtaccgtacgagccggactacggaatcggcacggcaaaccagggcggctcacgctcgcatcgaccggaccagacaccacaccaaccggtcgggctcgggcgccgcgccgcgccggccaaggcgaccgggtttagtaaaaggcgtgtggtgtggtgtggtcacgacgcgatgggatggggggtccgggtcgccaccggctttgtgtcgccctgtacctgccgggtacactattcggtaccagcttgtaccctaccctctcgcccctgcccttatctgctagcctcacacctacgtggtgccaaccattttgttgtgccggtgaaattaggtacttcttcttcttcttcttcttcttcttcttcttcttcttcttcttctttccctccgcggttatatagacgacgtgcatgcatcagatggtcatgagtgtgtgacacaccgacgcgcgctcatataattatccggtaaaaaaattcatgtgtaacacacgtgcacttaaaggattatccggtggaaaattcatgtgtactgatgtgtagaagtagcattatgtatgcaaatagaccgttatcgtagtttttccctcttcgtgaataatgtcagacctatatattagaaacaacaaagttggactcttaactattatatctttcaatgcacaatgccgaaatgttttctattttgtacatagttatacagaagacgcgcatgcatcgtgccgtgagaaggaaacacccgctagcaaattcacgtgtactaatgggtaggagtagtgttatgtagtagtattaaatgatcctataaattaccatattattgtgtgttttgcacgagtgagtataaataaataaatatgaatatgaatggtttgacataaagcatgagagcagtccgaatatatacgaattaattatatagtatgcctacaatagatggttatcatggtttgttgccatctactacgaataatgttagatctatattagaaacggcaatagtctcaaccattgggatcttaaccattatatccctaaacgcacaacttcaaactatcgtgcattgttgttgcacaatttcaaattgtcacgcatcgtaagaatcttgggtgtaaggcttacttatactttgtgctattcaatggaacttatgtatatagacctttttttatcagcaacattttattgtacatatagagaagatgtcaccctatctgtcacaaaataaatttactttcacccatcccacaagcaccaataagaaaaggactgcaacactccctcccacccaatttttcaaatctcaatacaattattcctcccttatttactctcattacatttatatctttcttttataaactccgatgcaccaatgctaaaaataataaattaattttaagataaatgagatgaactaaaaaaatacttattatactaggatgcaaggcataaaatattactccacattgcaaaatggaatcagtaattaactagaaataaattaatactcctaccctccaacttctaaagtggagcaaccactaaacccccacagcatttatataagcccacaccccccctacccttgttgtaccgaccgcaaaccgcaacaaagctcacgcctttgcctccccaaacaacccacctttcgcttcatcctcctcctcgccgccggcgagctcagccatgaaggccaagcgcctcctcaagcggctctcccgcgtcgccgacgactcccccgccgccgcggcgtaccagcagctccggccgaagcaggcggcggcggcggcggcgggggggaaggtgccgcaggggcacgtgccggtgtgcgtcggcgaggagggcgggccggtggagaggttcgcggtgagggcggagctcctcgggagcccggcgttcgcggcgctgctccggcgggcggcgcaggagtacgggtacggccaccccggcgcgctccgcatcccctgccccgtcgccgacttccgccgcctcctcctccgcctctccgccgccgccgccgccgccgccgacgaaggcgaatacccctcctcctacgactgctagctcgccgccggcgagacccgcggcgccgccctcttcttggccggggcgcattttacgctcttctgccactggaggcgtgtggccacaccattttaccattttacccctgggtaggattagagtgtacatacagggattgtgagctgctggtgatctgattgattgcagatgatggagggcaggattgggatttgggtactagatttttcacctacagatttgtgatttcttttatttactatttgttactactagcagtagtattatctactactagctgctgatggatgggaagaactatgggtgttcatttttttcttacccccttgtagttctaggatttgcagtagtttgtgagagggaggattttgtggtgttcagcattaaccatacatgtaatccttgaggctagtttgatgccattttattatatggaggtagtagtaatttttactagagcacaatgttgttgtgtttctttaattccctcactcttcctgtttactttatctgttgttctataagatctaattaagaaaagaagtataataatctttctcccaattaagagaacaacgcaaaagattcacatgattttttttgtgaacatcacggattatctggattttgactaaattttggtgacccaggcattgaattttatgtccttatctaagtaggagtactaaatgttttcttgcaatgcattttgggggcacaaagcaacactagtgcaagcaagctgtgatgccctgagatatttggtggtccggcctaagatggcaaaccaacctactgattgaagcagaatctgctaaagaaagcagggcattctgctccctttgcaaccgtaccactgcctttttattacaaatttataatcagcgccgacatattttctgaaaaaaaatcttcacaaccggttgtcaaacaagttttttttttttcaatttgaaattctctcgatagaaaatttaagttataaatactcaaatattgcaacatttggattgcactccgcatgtaaaaacctgactaatctgtactcagccaaaatcccttatattttgacgcggagcctaaaagactctgcatgtggaaattatggatggaaagattgttcagcctaataaagcaagagttttcgttatttcgttttcatgtcgagaagaaaaaggtccagatttccattggatggatgctaatgtttgtttgcatgttgagatatatggccaggacaggggcagggcaggaaggaagcatcctgaagaacttcaggtcttgtcttggtacgacccttaactgatcgtcaggctgtcatgagaaggacggctttggtttggcacagctgaaaaagagaaggggagatgagacagccatggctgatgacttggctgttcatttctcctgttcactctttaagctaggaaacattggtatcaaatcgtcttcagcgaaggcgataagttgaccgcggcgaaatcgcttgatgcatgacatgttgcactgttgcagtgtctcctcagtattttgcttgatctgaagggaagatttcggggagaaaatcggtactgatattttacttgaaatttcaggaaagatatgtgttttcctaggagaaaatgaagccacaaatgcatttgagtcatattatgctgttgtttctctcttgtaatgcagctgtcaaagttgacactttcaccaaatcaaagatatggttttttacagtttctctgtggatgcttccatgaaatttctgaatccaatgttttgtaccaccatataaatagaaactgtggtttaattcatgttttgcaatagaagaagcagcatccccatgtgcagagagattgactagtactacaattgacaataactacttaactgtgacttagctcagagggaagaagattcagaagagatccaacctacttatacacctaaagcaaccaatcttgcattattgttatcagcatcatggtgccctctttcctaatcattgtgacagagccaattctaaactgtttctgaatctcctcacctcaaaagaaagagagaagaaactgtttctgaatctcctgctcaaataaatcaagcaagccataacaaccacctgaaaaataaaacaggtaggttccaaatgcatcatcatgctacaatttcctaggtttcagcatgtgaggggagaacagaagtggaggcaaacaatgaataccaccaatttccctgctcatttaagtgctccctgatatgatgatatatcacagatacacactccatcagtcacatgcatgatgcagagcaaagagatacagaagcaggtacacacagctccttttcggttttgccattgtggaaaaagactagtctccatttgcagcacatggtgagcaccaggaagtttctctctttctcccctagttcacctccagccttttgcaagcaagtgcagtgcagcaaatggagccatggcaaaaatagtggtagcagcaaactagcaatgcactgatgcagaagtgcagatgcacagatgggaagggcaagtgcagtgcagcaaatttagccatggcaaaaatagtggtactgcacctactaaatttgtaactgaaattcttgtgtgtgtttttttctggttgcaagagatgatcatgtgagcagtgcagaagagggcacaatgaattagagaagagggtaggcaaaggtagcccatacggtcaaattgccaaaggcaggcaggcacatgatggggttcagacttcagagggggtctcaggccggtctctcctagtgtaaatttccagtggtcgaggggcaccacatggcacgccgcatatgcaatgcaatgccaaagcgtcgtttgctgacacagggcacgacacgctcggagcgcgacgtcgccggtgcgtccactgttcgggacgccggcggcgtggcctcgtcttgcggcgacaggcgaagttcacggtggatggccggccggggcgacaagagagagacatgggacatggctgctcagtgctctttagctgaaatcatgtggttctcgtcggcagggtttcctttgccgtcggtaaccctgcgcggttaccacgggtacggtaatataaataccacagtaacctccttaaattcaaataaacttaaaaaataatttgaatatttaacaaattttgcatggttttatattgttaccacgcgataaacatgcttaccgccagccgaggtgcgatatccccagccccgacggtttcccggtcgacgactcgtcgttcaggtcacgatggttttgatatgtagggcagtatgtttgagcttggagcgtcatgcgaagcatgtggcctgacgtcagcttacaagggccaaggttggaaggtacagagatgaacattgaaatacaacatttttatgaaaaaaaatacaaaatcgatcaagttaaaaattgatcgtttttaattcgattttcaagtttttaattttcaatatcacgcttgaaccaaacttggaaaaggacggcgtctagagattggaagaattactagtaccacgcaatgaaaaaatacgcacaagacggctaaaatataatccaactttactgaatctagtgaattgccgccatactttgtacaagacaaaaaaaaaaagtctagcttccaaccagccatttgtgttcgcaaattttcaaaccacctcttagtctcagctgtatcgttcagtgtttcggactagctccaccagaaaaatatagggcaatgctgggttgaatcttcacctcagaataggcagtggcacatataccaagtcggctccaactattttctaccatatacaaaaagatcagctcttactcgctgcgcaccgagttgtacttgtcagcaagcggaggtgaggccattatcttgttcatcagattcttgaacctcatgctgtaatcattaccactgcagacgtaacccaaaagatcaaaacaaggtaagatactcaaattagaatgcagatgtcactttcgaacaaacatatggcatgtatagaatggctgtatcgcaagtaaaatgaggtaaccatttgtttctagttatcgcttatcaagggcaaagaataaagatgtggcgattcactaataacgagaaagatgacagcacagttaaaagtgtggttaaaccagaaaaaaagtgttcggggcaggacagaatgatgcctgaccttatgcggcttagagcagcgattgctcgaagagcacttcgaatcatgtcttcattgcgatcaacctcttgcttcactgcatcgcccttgggtttgtgatttatagttttctcaatggggtcaactaatgagtccaaaactgagacagcatagtaagaatattagcaaaaagaactcagagtagggcatttgcatcgtatgaaacatccccgtaaggacctagattaaggcaacaaacctgccagaacagcagaagggcacttgtctgctagctttgagagaatcagatggcaaggcatttttacatcataatgatctacaaagtggttccataagacaacaaaaaagcagttattacagcgtgtgtatactaagcataaacaagaagatacgaatactagtgaaaaaagcactgcgaacaagtaaacaaaataaacatgacttatttgtgtgcggtgtaaaggttttaaagattacacaccacctatacatctatattactacagtggattaaacggaatgttcggtcaaagtgataaattatttagtgtaacagtacttaccacctaaaccagataagaggaaaggaacgataaatgatgatgggttcacttgatcaagacagctatccagcaatgtatccacacattcaaaggcagctttcctgagttcaagaccatcgtccacaacatgcttgaaaggcccaaggtcaactgttctgatcaattcttgctgcacaggaaaaaatcattacgataagatggatacaaaaaacattacttgatataacagtcctagctcacaacaaaacaagaagtcaataagaaactataccttaacaacagtttggtcatacaaaagaggcaataattcaggaagaagacccttaatcaaatttggcttgttgtgggcagctgtactcaaggccagcacagctgcacgcctcacgtgctgcaaagtgcaaaaggaaacaatgaacaccacatctagacagcattaagtaaaaacgctgaactgtgcttaatttccataccctgtcactgtctttaatcaacatcaggaaggtagaaatctcggagtacataatttcatctatttttccaggccgttcaacaattgaatattttatagcaatggcaactgtagctcttgtgtttgcagcaggactagatgtgcgttcctacaaaaaaaaacgcaaggaatgaaccaaaagacctctaatcattaaatgacagtagaacaaaatgaagaaaatagtttagatagtaatcccatttcacctttagagcagggattaatttcctaggttcaatcagagcaattttgcctaagcattctgcaactacattccgaactccttcctcctcactttcacagtgattaaagagcaatgccaaaatcttctcaatgtttgaatcctggagctcactctggccagtatggtcaacagactgccgtgcaattacctgagtgatttaaagtacaagcaagaattaagcaacaaatacatggagaatgcacatcaaaccaaatcctaatggggacaaacctctttcagtgaatgaagcaatagatactgtttcttctgttggttgtcaatctgattcaagataaaaggcaaatacttcgataaatttccaacagcaatgtttccgagagcatatgacgctgcagatttgatctcctcaaaaggtgactgaaatgactcaatgacaatattctcaatttgagcatgattgctgaggtccttccttcttccaatttctcccaaacataacaaggccatgtgctgtttagcctggtaaacaaagataggcagtcagctgaatacaaggagaatgatagagatcatatttgagttatttgaattcatgcaattaataaataactaatacttcaatggcaattttcatggatcagaatcaaacaagcacatcaacagttaccaaggactttcagactatacaatttagggtgatcctatcaaattgaaaaaaataaagcatgatccctccaattcagcatagtcatttttcaaaattgtcgaaggcataggaaactagttaagagagaatgtagtatcctatttcacaacgctatagagttataacattatctacatataaaagatgttgatatatgaaaatctatataactaacttaaaaggatcaccaagatatggcatgcactataccaaagagcagaagtactacataaaagtgaaacagtacagaagttaaacaacacatctgtcatcaagaatgcgccttacagaattagtagtgctgtcatcttttaaaatgcctttaagcatttcaatagttgaggcacacttctgatccccagctgctaagcacaacacagcaacacactgtgcaatggaagacaatgcttgtttggcaagtccacctgactgcgatggtttagcagtagaaataagagaatccaacaaagtgtcaaagcttgtatttgcagactggaccagtgaagcaaaaaatctctgcagtgcctgtggcagtaacatcccatgttagtgtcaacatgcaacttaagaagaaatcaaatatgtaaatgaaaaaaaaaatacctgtagtgcctgcccttgcaagagagcactcctgatcaaaataagggcctggggcaaaaccttgtacctcactgcaagaccaacattttggatggattttctatcgaccatgatcgtgcaacaaagttccagcgcaagagcagtcatgtgcaaatccatgtcactgccacagtaaatcaggtcagcaccagtcgtcatggtagccagaaaatgcaggattgatgaataacaacaaacctaatgagcgtagaaagttcagcaataatagtttcataagaggatccaatttgaccaccatacgcaacaacaagagaatttagtgttcccaatgtagcctgccttagagctctgtttgcctgttgaaataaatgtgcatcaaataaaacttagcgaacaagtttcataactgttatttaaaaagttttcccatgaatcgtgacaaaacaaagtaaacactgggtatacctttcgaaggaaagccgtgagctcagaaatgacatggtctaggacacacgaaagatcaatgcgaagaggtgatttagcaatcactgcaaacgcctgtaaaggggaaaaacattttatgtaccgagcagatcaacaaaacaaataggcactcgattgaaaaaatcaggcaaatatagaaaaaagaacttctaatttcaaatgtaggcattaagcaagtgataataggttatatcattaaaattctgaggaaatgatctgagcaaatagattggtaaaatacgtttcaactaagtttgcatcacaatggaccaactacaacacaatttctctttcaggcaatctagtgagatgtgaaaccagcacttatcaaaacactcgtagttcctttaacatcattgaccagaatattgagatacgcttgggggtatgggtttagttaactattctttcctactaaaatcttcaaactgagactaaaacaaaattgtgttccataaaacaagtcaattaagactaaaatataattgtgttaaagaaaacaagtagtgctcataagtaatgaatcaataaggagattaagcaatcctatctgtcagtaaaggtgcagtcgatagcttaccttaactgctgtaagtctagttatttcattacccattctatcaacaagaatgggaaggcatgccggcagttccctttggagaccatcaccaaacgtgaataccacaaggctcatgcaagatatggcacactctttaacttcctgaaacaaatatttccataagagacctgagagagaaagagacagatgaagatagggaggtgttaattttgctcaacctgatcctgatcctgatttgccaagcgggccaagatagccttatagattggaccaatatatggcctgtaatctagagtgcgtgcctgtatcacaaacaaacaaaggcttcaagaaacagaacttagattttgttcagcaacatatgaaatacaagattgacctcaaaatttggacgaagtacacgaactagctctccgcagactcttaaagcctcagcggtgactttgtaatatctgtctccaatagcagacaatattgggccagaaagggcctggaatttcactacgatcaatacaatgatgacaaatgccataagtatattttactgaagatatacgctacagttacctgtatgtatggatgaaacacagctggggaatgtgaagccataacaagtcttgtaaatacaagggcttcaatcttcaggttggaggtagatgacttatcctatgaaaaagaaaacaagttagcaacaagtagaagtcctgcacataatattttaagcaaaatgggaatcaccaacattcaaagccttctcaatcccaggaacaagtgacccaatatgatcagcaagacagtctggcagtacaacaacaagctccttcaatacagagaatgctccaacctgaaattttatctaaaatcagaaccaggtcgatagacatgatttgcagtcaaagagctcacctttgtcttgattgatttttcacgcaactgcctattgatggatttgacaaccttaggtacttcttgtttcagcaaccatctagggctgaaaagcaaaaggattgccaacatgggctcagtgctctaaacatggtaggatcaacttcaagcatgtaaaagtatttcaccaataaactgcataagatgctataacttggagaagttgaaaataatgatgcacataagagcacaatagacttgcctagactcatcaatgtcaccttgtccttttgtcatgttaccagtttggcgtaacaactcaataaatgtgttaaagatgtccatctagaatcatatagaagcttcatcagattgacaaacagaaagaaaactcagagactgacaaattattgatacaaagcaattacctttacattttcctctctttccctaaaccgttcgattaactttggacaagcctgcatattttttaaaaaagaaaaacatcgaagttaaatgggacactcattattagctaatgggtcacattactaactggtaaaaatcattacagaaacactatccgaaacatgggagaaatttaaacatgccatcaaacagaacatttttcagatgatcatatgttggtttaacatgattatgtcaatatacctccagatacatcttagacaacatttcaggacgagatactataattgcagataagcactttgctgaagccctccggactttccagcttgcatcctcatcatctgtgtattcatttgcgctctcactggagaaaatatcgaaaacatattttgatcaagtaaacagatgctatttatctattactgtaagagcatcaattacgtactcatcatcttcctcatcctgagcctcatcatcagtgtcctcctccatgctatcagtgaaatttggatcatagcttatatattccaatgcaagatttaaaataccctcacaatatggagatatatctcttggacacctcagcataaaactctcgagggcctacattatggaaaaacccacaggagtcatacaagagaacactcgtttcatgtaacattggaaagaagaaaattgttcacctgcaagctgtattcacggagctcttcatcattttccgatgcacttgtacaatagtttatgagcaaaggaacagcttcagcaaggtgtggcccaaaacggtatccaaccgagcgactgtaaatgaaaataatattgaatcaaaacttggattgccgcacaccagataagaaccactaaatcgccaaaaaatagtaaatatctggatttcaactggctagataagtttgaagcgtgaacatgatttcatctaagctattgcgaacaaatgagtgtgccctgttccttaaaagaactactcaaggcatacatgtacagttgaaagccaaagtatataccttagagcgccaatcatctggatatttgttcgggcaatttcagactttgcacttctatttttaagcaactggacaacctcaaaagttgccttggctaataaatcatcagacagacatgcagcaagtgatgctgaagaaaaatagcatgttaacagtcagtgtaaacacctttacaaattcaagccacccaaaaaaccaacatataacagcacagcacatcagttcgacttaccaatgcaagaaatagactttttcctaacacttgcttggttagagctcaactgggataacaaggcagtgagcatactatcatgatcttttgtgatcaagttgccaaatctatgaagtacatcccccaatatatcaaggcactcgcatttcacttccgcactttttccctgtcaacaaaagaagagttatcaaacctacccaagacatcccatggtatgacaaaaccaagtatatgctactaagccccaaaatccatatattggtttatctattataggcaggtgttaaacatgatgtgctggcaaaggcaattcaataaaccgctcttgtttttttaaggtaaagacgcataggtgaaagctaatgtgttcttatagttatgtggatagctagaaattgacagataaaacctcatggactgtgcatggtcagcatcattgccagatttgcagctaaaatctatcatgtgttaggaagggtagcacagtttcctaattaatttatccaaagaaaagattgctcatggtttatcatttgcattgtatttgctgcagtagctaaaattgcggtttgaaatttatggtggctagaaaaatctaaaaatattgactggtctggaaaactatccaactttctgcagtagcggaaggtactgtaccatggcacttactatcatggctctcaaactaaaaacaaatgttaaaacacaatttctttttggctctctgtgctgctaacataattctgaagttgtgaagccagcatataatgacttcaattgaatatggcaagcaaacatggctgaacacctaaccagactggatgaatagggaggtaaaaataaatacatagttacaaggtttgcaaatgtgttctttggtatacctcaaaagtataatgcaccatcagaaacgctgtaaacttaattagcaggctgaaactttcaattgtaatcactgttatcaagtcgcccgactaatcgtgattagtcatagattagtcgtaaagtcagtcaagctagtcgactaaagagccacgactcgaccaaacagcaagtcgtgcgattagtcgtggtaagtcgtggttagtcgtagattagtcataaagtcggtcgtaaattagtcgtgattagtcgtagcaaatcaccaattcaccatgctaattggcttattgtgtttagtactttagttttatttcttgttgacctattgtcttgctttgctactccatagtccatagtttatactccatacatttcttagcacagtataatagtagtaaagattatatattgcatcccctgttttttgcatgaccaagtcatggactagtcgaccaagtcggtccaggggtacctcgactcgactttacgacttgacaaccattattgtaatagcaaatacaaactatatggttcgaatggcacccgccgcaagattaatatggaagcatgttttaccacaattaggagacgaattgagaacttacagcagtggcgcccttgattagctgtggggcaagagacaccaaaatcttttcagcaagtgatgttgtcgtaacttccacaatgattgtcttcagagcaatactagcagtgtctcgatgttggtcctttccattgagtaacttatcacaaagaatgttggtcatctccaccaccctatcctcaccaaccttcttgacaagtggagccaagctaaccaagagaagtaataatacagattaacatagcaaaccatgaagtgcagaacaccggaatgtggaaaacataacagaacaattgggtatcaaattgctatactaaatgtgcttcaatggatgcaataattgaggcatgaagttgcagtgaaaaaaacagcagttagagatatatacagaaaaaaaaaacatctactgtaataatcaatgccctatattagtccagaaaattgaatgaggcagtacaaatccttaacaatagcaactgcaactaacataaattacaaaagtagcgagatccaaatgacagtgatttcttgcaataaggagcggatgatcaccattaacaaaacaaaatgctaatcagacgataccgctctcaataaagggagaaagcaattaatgcataccatttaacagctaaaccagagacatctcctgaagcatcttccagttgttgaagaacggtagtagtcaactttggctcgatgtcttggtcagctttgaagccctctttgttcaattcgctaagcaaatctgaagttgccatatatctgtagtccttatctttccctgtcatctgaaagaaaattttacacaacggatgttaagatcaaatcatagaaaaataaagagcaaaattcaggtttacagttcacatgcagatcagtgaaacccataccttctccaagatggtggttatgttcatgtttgccattttagctaaaccgtatccaaaagtccttttccgcggaactaatcactgttgccctgctggaaataacaaaaatcaagtataatgagattaagttccattactggcaaggtgaacagcgcacattgttgagtgtttgcatgctggcacagatgcaaaactcatccactgccaaactccagttcacgatcacagtgagaatcctcagttcctcgctcctttaaaaaggaggtgggcgtgatggtgtggtgtgctctattctacccccacttcggaaaatcagaagatcctcctccctgctagatctacggcgatacagaaccgaaaacctaacgccacgagcgaatcattcggatcgggcacctcgggttcaaagccctagaaccacatcacgcctgcagaaaaccagtcgaagcagcgaaacaaaccaaccaaccaaccggaggtaccaacctagcgatggtgagcccttgacgacgacgacgacgccggtggggggtgggggctagtcgagcggagggcggcgtctccagtccagtccagtgagtccagcacgcggcgcgatcccagcactccggggcccgagacaacgtagcggacggcgggaaccgcggcgggggggcgactccacgcggccggctcgccggcggcgaggggtcgggaaggggaggcgggcgggcggcggctagggcttggagagctcgctgtattttttgccgtcacggccctgacgccgatgggggattgaggggttttgggatcgaagggtggcttctactagtaggcttggcaaggtgggcggttgggcttttgggaattgggcagccttggatgggatatggtttcctatcttttccctgaggtttttccctgtatgccattaaaaaagatgatgtttgtctctgtgccactaaaaagttggagcctctttctatgccatcatcgaactttatcgcgccctccacactattccgtcgctattctgtgtgggtttaaccgtttggcagatctgacatgtgggtccgggcagaaaaaatgtcgctcttaccctttcagagagaggacaggcggcgtggcggacaagcggccaggcgtggcgctgaggcaggcgaacggcgcggcggcaaggtggccaggtggccagccgaggtgggcggcggcaaggcctccgccgcagggagcgatggccaccgccacctccatccacgccgcccaccgcagccaaatcgagatccctccccgtcctccaagccggcgactccctccccgtacagcggcggcattggcgtcatccgccacctacaactccctctgctccgccatcaagcgccactcccgcaagctcgacaccatgaaggctggctcctcctccggtgctgacgccttcggatcatcccagcccgtaggctccttctcgtcgcggaccaagaagatggatgaggagcggcggcggccggggagggatcccttctcctgccgatccgggtgtcggagtaggccggcaggggcgagatgaggaggagcggcggcgacggcatcttccccacatgtacatcttccccgggcattctctggccgctccttgaacacccacatatacatgttctccatgtcgtgctgcactaggaaagcatccagtgtagcattgttaccgttcccacggcggtgggggccttcgcctttccgttcttgtcagccaacatgaccggcttgaagtagtgggtgaagaagaaccacacgccccatatggtatcattcctcttcacacacttgcaggcagcgctggaattggagcccttggcatgtgatacaacgaccgtggtggtcgccgctgccggggcaggggatacgctggtggcagcaggtgagtccgagtcgtagagctgcggaccgccgaggccgacatctagcatgtcgacgttggggtcgtggagggcgccggcggccgcatagcagctacctcctcctctccttctccgtgctcgccatcgtcgaccagctcatcgacttcccactgctctcgttcactatccggccggacgccctcgagcatgccaccatgtacctccacctcgccgtgtacgcgtctgtggcgctcgccaccgacggtgttgcatcctcccaccatggcgacgcgcaggcgcagctcggggacgtggtggctgcgctcgccgcgtcggtgttcggccaggagctgtttccctcctcccccttcctcggggccttggggaccaacgaacgaacatgtcggccccaggaacgaacggcaccggcaagaacgcctaagggcaactaagtcatttggctgtgccgttacccatcgttaggaccaaaaacggacggaatggtgtggagggcgcaataaagttcgacgatggcatagagggaggttcgaacttttcaatggcacagaggcagtcatcatctttcttaatggcatataggtaaaaacatccttttcctttcctttccttttattttcttctcttttcttttcttttttttaaaaaaaaaatggttcggagatttgaaaatatagtgtgagtgtgagttataatcaacaaaagtatttctagtggtagacggcgtactcatcaacagcaacatgtccgtggtgacttcgttaatctcaaaatgtgtcggtccggtttcccgggtgctcgttgtgcatgggtacgatcatagggtgagtatgcgcgctttcatgagcgcatgcatttatactgtttttctgaaaaaaaaacataagtttttattatgtatttgtcttatctttcgcttcaaaataattcatacggttaaatcagttgtaatcacatctacatataatttaaaaatagtgtgatatagatggtagtagtagtgatttatattatatgcaaccaagctagatgtttttttaacccaaagcttcataccgatgctaagttcaggccttatgattgatgttgattacatctaggcatgaatgtatagtgttacagtaaggcattgttgtctttctgcagcttttaaaattgaattagaattagtgaacgtgttgccagatcgtcaaataaaaccgtggccatgtcctactaaagtagcaatttaattggtcacgtagacggtcagagttagttcgtctctgtaactctcattcacggttggtgccagttgttgtcgtgactttgttccttttgcttatgtgggtatgtacaaccatacgaaggcatacaataagttatgaaaaatcaagctgcagtatggattgattttgctatcctactatgtccataagtcatacgtgaaaatttccgattgaatttgttttaagattcatgtcaacgtggaagggttttgctatcctaccatggacaaaatttagacggggaatctgttttgttttttcatgctagtagcatatggagtgaaaaaaagaaaggggatttttagtttatcttcggatggatataggccatccgtttattttgatccactggatcacatttatttatactacaccatgtagtatgcacagcagaaattgtatagggttaaacctggaaaaaatatcccacggcagttaagtaaatttgccagcttcagtgacaaaaacgactgaaatttagcaactaactcctagtcacctcactgcaagtgggccagccctagcgcatgcagggttttttttacaggagcgcatgcagttctacgggcctcatcgtttggcttttttcgtaataaaccaaaacggtttattagaaaataaaaataaatttgtagttaaaacttttatatatgtgtttttggtgacttaaaagtcaatgctgaaaaaaaaactacgttaaaaatatctcaaaatcaatgccaaaattaagtttaaaaatttaaattttggctttttctttggctgaataggtatccgatgggagaccatgattcttggacagttcagtgtgaagtctgattctgtttattattttttggcttctgtttattgtttgcctcatcgagagaagcacaaacaaatttctaaaagatatatattggaaatttgatcaaaatgaggcctctaacagattcttaaacatgttcgcaaattttatccacacctaaaatcggtgcgcggtcttttatccgaccatgccaatttattttggatctatcaaaaatatggcgtcagatttttagttaaaatctaatataattgcatatgtaaatcagtgtaatttcatatcatatgtaatttaagaacttatattataaatacatactaattattttgggttaatttgatccatgccactgcaactttagctattaaaaaaataccattacaattcacctattttcacctatttgtaattgtgccattaaaattttataaaaattagaaccgtgccactcccgtcgcattttctatccttttccgtcttctcccgttctccgtcgcagcgcgccgcacgcagcgccgccgcaacctcggtcagccgccgcacgcggctgcggccggcggccttggtcgaggaaccccacggcccctccaccatcctcacgacctcatccccacgcaccactggcgccggcttgctcgagttcgccgcggactggactgaggaggagaccgacgccgctggcgagttttggacgtgcggataggcggcgggaccaggagagccggcctcctagcggcggcggcggcggaggaggaggcaaggcgttggtgcggtcgcagaccccgtgccgccgctgcggctactgctgctgctgctgcggctccggtcctgcgcgccccccgcgccgccgcggcgacgccgccgccggctgcgccgacgcgtgaagccgcgtggacgccgtgcttgccaccgccgccgcggttgcggtcggctgctgctgctggaccacccacggcttcgcgccgatgggtacagcgctgccgctgcggccgacgccaacgccggctgcgccgacaccgtgctcgccgccgctgccgtcatagacgtgctcaacttcgtccaggtatacatatacgtgattgactcgtactcgcatccacttcattgatacatcaatcgtgctgctgattatatatacttcgatgatatatatcaatcgtggtgttgattagaccaacaaccatgagagattgagagagtccacttcctagatgcagagcacctgtgaatcttatgagaaaaaaacagagatttttttcttcgattctccttttctctttcttttttcttcgatttcttctgttttttgtcttcctaatggctgacgtgccgtggctaggcatgaccggcggcgtgatgcggatgaagctgggcgacggtggcgcggcccgacgagggcgcggcgaggtcgggcggcgacgcgaccttgcggtggccggcgaggtgcggatggcggcggggcgtggccacgcggttgcggcgcggccctgcggtggccggcgagccacggatggcggcggggcgcggccacgcggtggcgccgcggccctacggtggccggcgaggagcggcgtagcaagccgaggacggctcggtgcggcatggctcggtggtcgggcgcccccgcggttggcgcgaggcggatggccggcgccctaggcggtcaacgacgcgatggtcggcggcgcggcagccgagcgcatgcgtgacggcggcggccgacgttgcctctcctgcttttcccctgttcattttcttgttcttcttcgaccagccaaaaacgagacgaagacggcagatagaagggaggagacggcaaacgtgacggtagtaggacggttttaattttgtaaaatttcaacggtatttttctgaatagccaaagttacagtagcatggattaaattaagaaaaaattataaccatgccattataattttacaaaatttgagatatgccatcctgacccacatgtcattgactcatgtgggttattgagataccgatggtatatctcaaactttgaaaaattataatggcatggttacaaattacccttaaattaacccaattatttttagcgaatccgtttattttctggtggcgccaatcctttttttttttcgcccgcgtctttttccccactctcgcgccgtcgtcttctttctctcgctagctacgaagtccacccgaagaagtcgccgtgcgccgtctccctcctccgtgcaggccctcgcctcccctcggcggggccaagggcgcagcttccctccgcccagatcggcacggtggccctccaccccgtgcggcggagtccccgtcgacgtagggcgtcgccggccggtcctccgtccagggcagcgccggccacctcagctgtccagtgtcttccgaatccagggccaaaggttctgcttgcttcccctcaatccaacatctattcctccccgacgtgaacgtcgccggtttccctctggccaaggtgagcaaatgctgtttaatttggtggtagtagtacttggttgaagcaactgctgaaattacttgtctggtacatgtgtgcacaaagattgtaattttgttcagtttgaggttcaattacaatgatcgatagggccagacctgaaattgaagttaaatgctactagtaataattgtactagttgaatataaaagaaaccataaaaatcaacaaatgcagatgaatctgtttcagtttttttttgaacgccgctgttttaggttttaagttacctagacagagactttcagtttgtttctttggttcagaattgtggaactttaggagcctatcatgttttgatctgttcattaccatgtatgtgatttatatcgtggaagatgatggcttggcggtatagtttcagtaatctgaaaatcaattcactgtacagaataagagtgctccaacttcagcctcaactttttatattcacatttataattttaagtactagtatatttatacatagaaagtttatgttgttcctctgagatttgatgggtcagagtaaaaattcagttctatgattcttggacagttcagtgtgaagtctaattctttttcagttcagtgtgagaacatggtaatgtgctttttagcatggaggataatggcttgtcattatagtttcagttctatgaaaatcaattcactataaagaattgtctgtagctgcttatgtgtacatctagcaagcccatctgcgtgcgtggaaagaaactcgctgcccaccgtaaaaaaaatcgatgcaacaaaccaaccactcatcccaccttgctgctacgtggccaaccaactaatttttaggatctgattagtggattttgagccgcccaattctttttggaatggtcccaatccatagtttttgggagctaatttttagggaatgtgttttaaaacatttattttgagttgaagagccataatagaaagtgccatagtacattacattttttttttcattgaaagatcatgtacattttcatgactcgaaagtttactcttttttcagtactgaagtctgaagatctgtttcatccaccctcctattttttttttctaataatggaacgggtaatggaatgtgattacccggcttcaaagaagaacaaagtggttcatccaatggattgcgagatgaaggaagagccaaccaatgcagcaagcatgaatcagcattctctctggagccagtggcagctcctggattccatcctcccaactggcgggttcgcgcattcgtatggccttgaggccgcaatgcaatcccgcatggtgaacaacccagaggagttgaggtcatttgttgtccaggtcttggagaacactggcagcctgttgcttccatttgtgtgctgcgctaacaagtctcctgatgccgcaacgtgggtgaagctcgatcagttgctggaagctatgttgacgaatgaagttagcaggaaggcctcgatgtcgcaaggctcggctcttctgagagttgctgcttctgtattcactgagattcagtcgctgcaggatcttcgacaaacattccttggttccaagattgtgtcgtttcaccatgcaccgatatttgggttgatatgcgggctggttggattcgacagcgagacaacgcagcgtgcctacatgttcgtcacaatgagggacgtgatctctgctgcgacgaggctcaatttgatcgggccgctagctgcttcggttctgcagcaccaggttgcggaagatgctgaaaggatggtgcagaagtggaaggatcgcggtgtcgaagaagcaacgcagacatcacctctgcttgatgcgttgcagggttgccatgcttacatgttctctaggctgttttgcacctgacaaggaggtgtgcttcatctccctgtttctttcttttttatacataatcccctcgatgtgtttgcagagttgccatgcttacatgttccataggctgtttctgtacatttgttttgaatggattcacctcaataaccatgtcaattttatgacacaaacacttcaattttattgtatgacacttccataatgttttgaaatgtgattagtgcagtgcaatgcaattgagtgatgaaataaaattcagatgagtgatgtcttacatgatgagcagttcactcaaaccagtggcgcattttttcccttttaacatataggagttctttgagatctgacaagcccattttcttgccatttaaggccacgaaacaagatgatcatgtcatacactgaactattgaccttactctgttcatcccctgtctcttgcagattgctaactgcaattcgctgtaactcagcccacggtttacacttttaccctggacggttggaggcagcagaggaccactacattctgttaaataaaaagacaccagaagatcacaagcatcacaaggacagattctcttggttgattcttattttatttccaagcaagattgtacatcagcaatgccaacagtaggttacattctttctccaggttgattattattttatttccaagcaagattgtacagcagcaatgccaacactaggttacattcttgtatgtgatccatgtctattatctattacagtgattgtaccatcatttgtcttcagcttccacaaattacaacatcaacttgcatgacacatatcacaaagcagtgaaagcacatcttttttcttctgctccataatacaaatacactggttacatctgttgctccaggcctccagttcctacctaggatccttgaactgtaggggcttgcttggcttcaagggatttctcatactcctcaatggacttgaacagctccgagaagttgcccttcccaaacccgccgcagccgcccttctggtactcctgcccactctcatccttctccatgcacccaatcctttgtatcatctccaagaaaaaggttggcctgagtgaaatagctgatccagttagatttggagtcacagagaggaaataacaatagcaaagatgcagcagaaattagaatactgactgaatcagactattaagcttaaagacaattacaacctcctgaacctaaagtttaagttgttcccagcagcattgctggtttatgctgatggagttgccataagattctttctttcttttgtaaaaaaaggaatccatggaccttagatgtagtaagtaatacttcctccgtttcacaatgtaagtcattctagtatttcccatattcatattgatgctaatgaatctagatagattagcatcaatatgaatgtggaaaatactagaatgacttacattgtgagagggagtactcactaattaagtagctatatgtggctggctatctgcattacaacatgccggcaaaaaggaactgggatatgcttgcaagaaggcataaacagacacacattggcttttcatttttttcctatgcacattcagctttattccctttctagtgtcacaatcttcagaaaggcgcatcatggattcatggagacacataaagagtatccatggagtatcacagagctcactatcatatattatactgtattattcaagcattctggattaatttcataatgcttgacacctttctgcgcctaatcgatgctatgtgccaacaaataactgcaaatctgaattcataagccattttcatcatgaaagaggtgaggattttacctgtctcctactggcttggtgaagatctggagcaacaccccctggtcatccctgtccacgagcaccccgagctcctggcactcgttgatctgctcctccgagagcacgtccccggcgcgccgccgcacgccgtcgtagtagttgggcggcggcggcgccaagaactcgaagccgcccatggcggagcgcgcccgcatctccctcagcgtcccgagcacgtcgtcgctggccagcgcgatgtgctgcacccccgggccgccgtggtggtccaggtacgtctgtatctggctccgccgcttggtgccgtgcaccggctcgttgagcggcagcagcacggtctccgcgttgttggcgagcaccaccgagttgaggccgctctcggcggtgcccacgtcctcggcggtgaactcggcgaactcgtggaacccggtgaacccggagatgtacgcggctaccggagcgagctccggcacgttgccgacgacgtggtcgaaccggcggaggccgtagtccacggcgcccgggttgctgacgccctcgaaacccgggaggaagggcgcgtcggcgccgtccgggtggctgacgaagcggagcacgacgtcgccgtagagctccacctccgcgaggccgaagccaccgccgaggtcggcgggctggaacgccgggcgcgcaccggccgcgacgctggcgcggaaggcgtcggccgcgtcggcgacgcgcagcgccacggcgtgcaccgcgaggccgtggtccgcggcgaacctccgcgcggcgcctggggagaaggaagggatggaggcggtggtggccgcgtccgcgccgacgccgtggtcgccgccgtagggggcggtgaagaggaacgcgacggaggcggagcggaggaggagggaggcgtgcgcggagttccccgtggagaggtcggacctggcggcgagcggcgcgcccagggcgaaggcgaaccggcccgcggcggacgcggcgtcggcgcaccagagctcgacgtggtggaacgcgagcgcctggaaccggtcgctccgcgggttggcgcggacgaagcggcggtgcccgacgaggcggaaccccgcgttctcccccgccgccgcagcggccgagacggcgccggtggtggcggtgggggtgggagtgggaggcatggcgcggcgcggcgcggcgtggcgtggcgcgtcgtggggtgtgggggagtggatgacagtggcggcgtggggggaggagttggtggtggggggttaaataaagggaggagatggcgccacgtggacgctaagtctagtggttgcggacgggatttgtcctctggtgctggttgccttggctgctggtgaatttgtgaagctgatgagtttgttactttttttttttttgagaaaagttggtgactgttctgatttttagagggaaggggaaacaaattttgtggtaacttggagtaaagctcttgtttttactaggtgattatatgttcaatcatttgttttattttaaaaacatgtgtaaacataagaaaatataagtcatatttaaaagtgtttttaatgataaaccaagttaaaaaaataaaagataattatattccttaattagatgaatgataaatatatatttttaaaaattgatagtgttatctattaagaatcggggagagtagtaatggaggattttcttattgcaaatggatggatggtagtgtttttcacatcacttctctaaaacgttttgtgccacatatattacctcggtctcgatagacatatgaaaagcggtagaatgagctgtctcaaacagtcaaaatctcaattgaagatatctctactgcttccttaaaagcatttgatattggattttgatttagtgtgacgttagccattattttgtattaaaataagtttatgaggccttgaaattatttgcaaagacaaatgaacacaacattttttcatgatttcgatgtaaatattttgatagtcgttggccgtctaagtttcaaaagattttacgtaaaacatcaagtgtttattaccgctaagcagggtttatactttgttgactgaccatcgataatcaccttcggcaaaatcgtcagtaaccgtctggttatcgtgatggctcttctttttttcgaatttgaaacagcgtccttttttaagggatggaaccattccgtccggcagaacgttttctaaacttctaaacaataccattttcgtaaaaagaaattatatacatttttcatatgaccgttttaaatatattatcatcaactattcgtgaaaaaaaaagaacacactctatagggctcagaatatgatagaaaacgatatgtcccgtagcagaacatcatcttggtaagtaatctctccgtttcgaaatgtttgacaccgttgactttttagcacatgtttgaccgttcgtcttattcaaaaacttttgtgaaatatgtaaaattatatgcctacattaaaatatatttaactatgaatcaaatgataggaaaagaattaataattacttaaattttttgaataagacgaacggtcaaacatatgctaaaaagtcaatggcgtcaaacatttcgaaacggagggagtaataaaaaccctcatccaaaaaaggggataataaaaactactccctccgttttttaatagatgacgccgttgactttttctcatatgtttgatcattcgtcttattcaaaaattttatgtaaatgtataagatataaatcacacttaaagcactatgagtgataaaacaactcataacaaaataaattataattacataaattttttgaataagacgaatagtcaaacacatgagaaaaagtcaacggcgtcatctattaaaagaggtagtatggcatactacaaaggagatctgaaagtacgaatctctctttagctttttggatagaaacgtttttgatctcttgatctcgatcaggagctggataagcgattgagtcatcgctgtgctgccttggtttcttgcttgactgtctctgttcatcagttgaagtagatctctcgacgcctcatcatccatttctgaaacccttgcaccattcctgcacgcatgttgctgctggccgttaggtgtcactgcaaccgtcacctgtccatcacgcatatgcccatccagaaacggaccaggagggctgcagtgtcaaattgacttactagcaacttgaaaacgatgtaaccaagaagcaaacaacaatgagagcctgtgcaagaccccaagagggcagcactcaatttgggaagccaatctggaaactcgagagcagaagttgaattcaaattggatttgctatgcggctggctgcctctctcgcgagaggggatcgaaatcgaataggtgtgtggtgttggttatgggcttatggcgagcacaaggtgtgttcgtatactatgtactcagaagtcaaaacctttagaagcatcaaaactaatccattaatctagtatacaaactactgccaaaagtcctaaaactaggtacaagtaatcccgtacaaccatggaatatatatactatatgttaattgcacacatatgtatgcaagaattaattgcagtaagagcaaaatattacaactagctagcttctaggagtacatgtatattttctaggtgagccagcagcaaggagaagaaatcgtaagttcaaggttaatggccgccggcggcagcggctgtgtggaacaagcaaaaggatgacgatgaccatgccgcgttgatccgtcgtcgttgatgatgttaggcgccggtggctggatcagaagctcgtcgtcgtcgtcggtgatgctcgagccaccgtctttcgattcttcagcggcgccgccgctgatcgacagcgtcagctcgcagccgtcgtcgtctccggcgtgcagcgcttgccgccggtgaggtctctggtggctatggctcccaattccagctgctggcacctgcaacaagaaaaatcaatcaatcaatcaatcaatcaagacactcaaatgagccaattaattaattaattgattagcgttcttgatctgtcctagtattaattagagctagaagaaaatggttaccgttcttgttgcaaggaagctgaagctgctcatctgtcgtctctgctgttcatcctgctgcgccgtcgtcgtccaatcgatttgtggggtgacaggatgacgacggttaacattgctactgttgttggagttcctgtacatctgctccatgcatgacgcaaattaatttggtttaattcgattgaaattaaaagagatgatgatatttttagtgtagtcctggctatatgtttttagctacctgaagatggcttttaacgtgcgatatactgactcccttagcgcccatcagctgcataattcgcttcggtgttgcctctgtaattcagatgagaacaaaaacaaaagttacttcgaatttaatttttagggattagtacatttttaaataccgactaataccacggttcagtttggtttctccgaatagatggcagtacatttcaaaattttcgattttgtgatgatatatactccttctgtccaaaaaaaaaaaactaatcctgggtttgtcaggtttaaacccaggattaggttttttttttaaggacggagggagtatatatctccaagggacacaaacgaagtctcatattgacgtgtaattttttttctcattcgtgaataaaaaacaaacggaatcttgagaacttatccttttccttttaaagaatgagcaatatttataaatgcaaaagttgtatattaaatgtaccatttagaaatttaaaaggcatgtaagaaactgcagtataagatagtaaaggaactggtcacaatgctaattaagagattactaggggttattcagattgtaactaaaataaaccttaacaaattttgataatgccaaaattttagcaaagtttgacaagaaactaaatatatgcatatatttaacaactctacttagaaaaaatggtttgaaatgctatcaatctgaacgagtgattggtttaggctttatagttgagggagatcaaattaacatctaaattaactgaccgtggcatccgccgaggcggcggacggcgtggacgaagcggcggtgcagctcctccggccaccgcatccgcggcgcctcgctccggttgtaccgccggacgacgaccggcggcgaccccccgccgccgccggcgctgcccattcgatctcttcttcctctcgctcccatattagcttccttcaatctagaactactagaagcttaattagcaatgcgacgatcgatacgatggatgaagctagtacacatgcacatcagtacacatgtatatatgctagtaattccattaatttgtgcctaaccctgggtatatatatacaagcaaagctaagctttgcttatgaaacgtacggccaagtgaccactatctgtaagaactctataatgagttgataattcatctaagaagccgtacgtcatcactttactgacctggtccagtcaaaacacgcacgcccgcatgcatgctgaattgctgatagatcgatactaactatgactctctgagatatcagatatgcttgctgcctcgtagcattcacatgaatatacgaataagaaaaagaaaagaaaaaaataagaaagaaagaaaaaagacaggcttatagctcatctattgtactcgtggttatatcagctataaacttatatagagaaaaaaataaagaaaaaataattagtgttgacgtacactaatgcgagagctaactctacacatgctctaaaactaattacattaattacataagtgagagaaaaagagtgggaaagagaagtaaataaatataatcttataactaatctattatatatgttatctctaattaatatggacttgtagctaatagttagcccactattaaacttgctctattgtgtactctttatcttgggttgtcagtctttagattgtttcttcttgatggttggttttatcttttaatgagtgtgaaattgtaataattgactatagctctttgagcaaaggccgggatgctctattccattatctaaaacaattaaacttgctctaatagacttatatttaatagttagctctaatactaagcttagtactagctggtttgataatattagcactaataattatgtatattttttttatcccataaaaaaataattcccgactgtctatatacacggttggaatttgatttttttaatgtctggaaatatttttttttaatcaagggcaaggagcccccatttccattactagaatatatctggacatatataggtcctatttagtttccaaaaagttttttccaaaaacatcgcatcgaatctttggacacttacataaaatattaaatatagataaaaataaaaactaattgcatagttagaggggaaattgcgaggcgaatcttttgagcctaattagttcatgattagccatgagtgctacagtaacacacatacgttaatgacggattaactaggctcaaaagatttgtctcgtggtttccaggcgagttatgaaattagtttttttattcgtgtccgaaaaccccttccgacatccggtcaaacgttcgatgtgacatccaaaattttttttttcgcgaactaaacggggccacagtggctgctgtttcaattcgttggtccacgtatgggtacggcacgcatatgtcgacgtatgtcgattgaccctacccttaccctatatggcttgatcgaaatgtaatataattaattatatacatttcgtcgttcattattgattgtaaaatataatcggtcgaatgtcatccacacgtgctacagttctctcaaaaaaaatgatattttttttacaaaaaaaatcatctatatatacatgtgatcgatcattgacaacgatttgttgttagaaaatgaaacgacggattaatcggtcaatgtaatttaatcaaaggtcgtggtttctgatcagccgtacatagcaaatggcagtgtcaggggactagtagtactccctccatttcaaaatatttgacaccattaactttttagcatatgtttaaccgttcgttttattaaaaaaaaatgtgaaatatgtaaaactatatgtgtacatgaaagtatatttagcaatgaatcaaatgatatgaaaagaataaataattacttaaattttttaaataaaacgaatggtcaaacacatataaaaaaatcaacggtgccaaatattttaaaacggagggagtactttttattccgtacggaagtcgtactaatacttttcttagtatacatatcacgatcgatgagtgctttacattcttgtcaagattagtgtcaacggctaatgtcatgcatgtggatgccgcaatgcaaacacatgtttctccatgatattggtcgcttgtttagttgtttacacgatcaaaagccaaaaacagtgtgcacgaaagagttgtagctagctagctagctagctctcatattgtcatatatagggcatcgatcaaagtggttccaagtcaggtgaaccgtattattaattctccctatatatatggtcatccgttcacgtcctaaattaattccttcacccctaacactacaaattctttaacatatatatgatgcttgggctaggctaaccttttggacgagctaaattttgaacgagttctattgacagagcagaaaaaaattacgattacaaaactgtaaagtcgtaagaaaaaatgaaaaaaaatatcaccacccacacaccgacagcgccaacacactggttgagttatctagactagaggttttgttcatcggttgagttatctagactagagatctactttatttacacacaagtcttttccttctttgtacaattatcttgtacatgaacaactaatttatcttccgctatattcaacgaaattggtacaccaaataccgatttattttttagaaaaaagaagaaaataaccattggaatctgtttttatttttcaagagaataacatatttataactaacattattttaccatctttaacaagttttgaattattactagctctaaaatatatacttgtgcctccttgtagagaaaatcccttatgtacggatgtacccataaattttcacctaatcccttatttgcccttaaattttgccttatcccctacttaccatcgacttttcatctttatcccctatatgcctattccgtgagtccaaaaaaatgtctatattaccctttgtctacttattggttagagttgattgaagaaaaacacggttctcaacataaaagttgattcatttataaaaacaaacatgacataattactttatcataaatttgaaaactaaaacttagattttttaaaaataagtatcaaattagatttgatgaaatttgttcaatttttttgctgaaatttaatcccaaataagaaacaaatttggtttttcaaatttcgactaaaaccttttgtgagtttcatattttaagaatgatttaaaatttgtttttttttctgaaatctggtgtcaataatcacgtctcttttgattttttattatagattaagattttttataacgagacttatgtttttaaagtaggtagcataaagtacaagcgaagggtaatatagttatttttggagtcaaactcaaggcaagggtatagaagggatcaaaataaaaactcagaggtatgcagaggatgaagcaaaattcaggagcatataagggattgagtgaaaacttatgggtatgtgaggaattttcttgtccttgtactccccgatttcatattctaaaatgctttaacttttttcttagtcaaatagttaaagtttaacagagtatataagtagaacatagtagtatttttaacacagaataaattattttaaaaatataaatttaacgctagatgtaataaaactaatttgatattgttaatattactaaattttcgaataaatttaataaggctaacgatcgtactcggcccatccaaagcccaggcccaacaagaagtagaaaatgggcccaccaccaaatctccccctgtccttccccatccactttccctcttcgtctccattcaattcaaaatcccctccgcttctcctcctctccccattcttctcctgtctctctcgccgcctccaattcctccaaaccctcatcctcctcctccgcggcggcggtggcgacggcggcggccgcaccatgggttgcttcctctcctgcttccgcggcgcgggatccgatcccgccggtagcctccgcgtaagccacagcccccttcccccccgtcggctccccgatccgacaccccttcgtctctgtgtgtgtgtgtgtgtgtggtgatgatttttgctgccttgttgcaggatccgctcgtgcgggagagccggatcggggaggcgttcctggacgacgagacgagtgggttttctcttccgttttcaactggatgccctttgcaatttttttttttgttttcgctgtgtacgatcggatcggagctgagggtgtacggaggtttatttggtatttctctgcagaggttgaagcgagcgggacgctggatggggatcgcggaaatggcggaagcgtcgacgaggagctctggcgagaggtagctgcaacgttttcttctctacctgtttttactgttgtgtggcgatttcatcagaacttggtggcatatctcgaagcaccaatgtttctagagtgatttatatcaaaattgatcctcatggttggtgaggagtaacaaaattggacctgattgtgtaatctacagtgtatctcattgtgttgtcacctatgtagtattgatgtgctcttccagtggactcccttgcagctttgtaggtgcttggttatgctctctccttgagttgtaggttatgcgaaaacgacattggttgccaattttgttgtttaggtccaaaatttggctcttaatatagtcgcgcttcactcgatgtgcatagaatttaccgctaaaattacaccttaaatctttctgaagctattttcatgcctgcacctatcctcacaggcaaaattaaactgcaaattattttactcttttttactttaagaatttgcaaatgtgtgttaggtcacaaatcagtgttcagctgtccagtccattaccatgtcaagttcttttggcactaacctcctatagatggatgagataaataggagtagttgataattctctgattatcaatattagtatccagatatatattatgctacagttacactagagtgaaggcagtgagctttttgcaggtcggtagattatatttctatgatgatcactcgatcagttaagattatattcttcagatataatgttgtactgattttgagctgtcagtgtctagttttcattcaaagtaccataaaagagtttactgatgcccaacttgctgtctgtaggtttatgtgcatgatattggtttatgtagatatattgttgcctcgatcaaatctatcttgagattgatgcaaactttcaacattcatcacatcttctatttagtataacgcccttgcacatgcttaaagaactttgaatggatgtcctacatgtacatgtggtttgcattttcattgggcacactacatggaccataccatgttttaactttcacggttctgctttaacagttgaacttcatcaatacatgttacattataatcaattctttttttttgcggggacattataatcaattcaactgaaattaatttcatagcatctctctataaccaggcaaattatctgaaatcatgtggtgcgataggagaaaccccaccagaaatgctgaaagggtcaaaccaaatcactgaagaagaaactaatggggtaaggagtgtgtttctgcatctttgtttactaaaatcggcttatgatatctttattttttaacacatactgtaatgactaatgacacatcatgcattatgcaggagcttaaaggagcagcggtgtctgaagaaaacttatctgaagggtaaacaaataccatcagttttcatgaatataacagtattgaatactactgtcactaccatggtcacataaccaattcttcctttcttgtgatacaggttcaactgtgatgagcatagtgctttgaaacatgaacaaagcgattcacctcacccaacccctctggttctcagaggtgatatgcaaactcctggtacactgaatactgcatataaggagtctttaaggtctgggaagcgtgcaaggaccaacaagcaattcatatatcctgtcctcagacctatcgagaacaaattacaatggatggaactaagagacgactcttcacctatcctgtcattcaatcctccaaagagaagatacttgagcacagattgtagcgcgaaacctcaagagtccatcacaaattcaatggctacgcaaacagcgcgaataactcctgcttccttctcatttcatgacattactgcagggcaagatcaaggagtgatatctccggaggaacataagagtgagaatgacagcagaaagctgttagatgatgcagatcaattgaaatacaacgcagacagtgagaggaagggtgttgcaagcctttcttgctggcttaagcctccatcttcagctggtgggagtcaaagtgacacggagggcaaggtggtaaagcaaagatgctacgagaatagtgttttcacagacctgcctatctttacagcttctggtctgaactgggacaatgacaagcctactcctgtgttgccaaaggtgtgggatggtaacggtatcccaaacacaactaccaaatacaaggaggtgaatactttcatccgatgctctctataccttgcacttactacttatttgccctacttacactgttgctttgctgttatcaggaccagaaagtcagttggcacgcaacgccttttgaggaaaggctgatgaaagttctgtccgatgagaaaccgcatcatcaaaggtctcctgcttatgctctaatcatactctgcaacctactgttacttgaaattactactaatattgacatcatgatccttgcaccaggaaaatcagcggaaagctgatccaacttgatgaagagaccaactgaagacccttgcaagaagaccatcatcctcgtagcatttgcatcatcatcatcatccttgaaacagtgaattttttgaaagggccccagctttggctaatctgatatggactctagctacaagctgcgcatcttgtcatctgtacagcattcgcaaatagggtgtctgagctacattctcgtcaaatttcatttcggaccgttattgccaagttgtcaacttaagttgtcgtttgcaactttttgttttcctctgtaaagaagatgatactttatctgctgtgaacatcaactgccgactggagtttgatagtagtatcaatgaaagaaaacttctcgtgtactccctcctgcgtattacactctaccgtctagccattcttttattaaaagaagtatacctttatttgtctctgcttttgatttcttgtttttctaatataaggaaactatctaggacaaccagaactgcgagttttttttggttgttattagtacctgatacatttccattatttcttttttgactttttaggcaactcatcagcaaatagtggatcaaaggtagtaatccagtctcaatgcattatcacagtaagccagactgtaagactgttcctctaagctgctagtggcagaacctgcaagccagaatcttgtactacaaaggagcaaatagagcttggagatgctagacacattccccatcaacgcagctgtgcttacaattatcgccaaatcattgaggtattttcgtcgagtagcagcagacacagcaaggcacagcaactcaaagctgttcttggtttcttagagagctcaagtttcagtcacaggctcacagtaactggctgacctgaccacatgtttataacagtttcgctctcaggaaatctcacctcaagacacagccacatatctgcttcctgaatcaacctgatggatacagctcggcagtggaaaggacatgttgcattgcattggtccaggttacagtcttgcgctgtggtgaacacacactgatgaacaattggacatggcaattgctcctctaccgagcaaactaactactagggtggttgcagtgtaaagtccagatcacaaaaaatggcacattaaattacatcatccggacagatcatccttgtcagaccaaaacgcatgcagagaggtaaaaaaaagggatcaagaagttcagtaaactacagggaggcttacgatttacagtggcatgaagagaacaatccaagccggtgggtggagattaaaactgtgggctcccaaatcccaatcatggcaagactctggacaggctctgtcacattcagatcaaatcaaaccaccacaaaacaaaaccacaggcagtgaatgtacaactacaccgtgtcaccgtgtcaccagccagatgatctagctagagcagagaggaggagtagcagcatgcaggtattcaaatggtcagatattgtaatcctgaattcctgatagcctgatggtttgcagcttgcaggatcacgggtacgactgttcctttggccaaaaccctgcacctctctcactaaatccatgtcgttttcgttgcaacttgcatccatgtatcaactggttacagatcttgcatttgcaatactcttctccccaagttgatccatgaatctttcatccctaataaaaaaaaccaaaggccgaactgaaccgcactgaagtttcacaaaactgaataaaccatataaaccgaatgcccacccctaatccaatatacttattatgtacagagtactacattatattctatactgaatagtttcttgttcagaaatactactttgtcgtagaatataagagattttatccatgtaactataaaatctcttattattctgagatggaggtagtaacttgatatggaatagtgctactgttttatcttactgtagtagtggtcactatggatctttacatttgagttaaaaggcatgggaccaatgtgtcttctccttggctctccatgcatggggtgagtgataagagtgagtgctcttgcaaaaacctgatctccagcaagcaagcagacaaaacgcaagattggaacaaataaatagctacacccatttgagttgggcaagatgccaaatggtctccctggctgcaccaacagcctatcagcatctaggcatattgatctgcaaaagggtcattacctttgcagcgtttgtcaacttgctgcttgtccctggctttggcacttaactaattagcactcacacacataatcacgcatcgagtcacttagttaatcagctcaaattggtgacttgagacagttcaaccaacctcacatgttaacttggatggctctgctgtggttaaattaattctactgtggttaaattaatcgattgacccatgtcgatcgatggaggtatgtggtgttaaattgttaatgtatgcgttctttttgtgcctacgtgcatgcaggcatatcttttggagattcgtagacgtttttgcatgccgtgatgttcaagttgtagttcaaaattgggagaggcttgtttcttctaggatttggatgtgctagcttgtgaagaaaccaagacaaaagctgcacattgtcctagctagcaagcatagcttccgcctcagatttcaaattgtagttagttttagactcgtgtacaagaattcagaaacaaacacataacacatattaggtgatattcatatagaacagttcaattccaggttgtacagtgcagaaatattgagaagtcgctagcataaaatttgaaagtatatcttaagtctggattttatactatcaaatatggtactccctccattctaaattatagaaatctagtatgtgaaaagatatatactaatgatatgaatttgaaatatgccttctgtcgagatcgagatccatagtattaggatgtttcccatcccatgctaaattgctactccctctgtttcatattataagccgtttgattttttttctagtcaaactttttaagtttgaataagtttagaaaaatatattagttttttaacataagacaaacatattaactaatttaatattttaaatgttgcttaattgctctataaatttgattaaacttaacaaagtttgactagtaaaaaagtcaaacaccttataatatgaaatggagggagtatattttaaaatgaagagagtacttatcaaatactagttctataatcacttggagtaaccagacaagtgaggctaccttctttcgtaagtgttgggtataaaacggtgtgaatgattagcacacaattaattaaatattaacttaaaatatgaaaataaattaatataattttatttttttaatatatttttttcaaaaaaaaacaccatttacgatggaatatgagttaggaaatgggaggaaaacaacacaccctgtgtgttggcagttggcacagagacgaacacgctcaggctaaggggaaaaaacggaatagcgagccggtggccgtcaccttccccttggcgttgctgcgtctgcgtgcgtcgcgcgtgcgcgtgcgcgcgtgggcccgagactgacaggtgggccccacccaccagccgcccacgctttaaccccctctctcctctctctcgccatttacgagagcgcgcgcgcgacgcgagctgatgcttccgcttggccgccgcgtcgccgaagccgactacccgccgccgcgatgaccacgacgtcgccaccaatgccgccgatgctgccttcgtcctcgtcctcgctccgcgacctgctcgagcaggagcgctgcgagtcccacgcgctcgccgcggcgccgcggcgggcgcggtcgggcaggcacgcgtcgccgccgccgcaacgcgtggcgccggaagaggaggacgatgggggaggaggcgcggcggcggtgggcgcggtggtggcgatgctgtcggggtacgtggggaggttcgtgaaggacgaagggttcaggcgcgggctgcgcgagaagtgcgcggcgtgcctcgcgcccgccgcgtcgcggcgtggcgccggccacgccgtgctggccaacctcgagctgggcatcgagagcatcgagcgcctcgccgccgacgccgcctccgcgcaggcgcagcagcgcgacgccaagatccgctccctccgcaactccatccgcctcctcagcgtcgtcgcctcgctccacgcgccgccgcagccgccgcgccacgccgctcccacctccgcccccgcggcggcggaggcccacacctgcggcgtcccgaactcccacctctccgcctgcgcgcagctctacctctccgtcgtctacaagatggagcgcaacgaccacgtctccgcgcgccacctcctccaggtgttcgtcgacgcgccctaccttgcccgcaagaacctcctccctgacctctgggaccacgtcttcctcccccacctcctccacctcaaggtctggttcaccgccgaggccgacctcgcccccgacgaccggagccgccggatgaagaccctgcagcggctgtacaacgatcacctcaactccggcaccgcccaattcgccatctactacaaggagtggctcaagtcaggaggagccgaggcgcctcctcccccctccgtgccattgccctccatgcccggagatttcgatgcttgggacaagcattcctcttccctgcgcagaagctccatcaacagaggcctgtgggtgaaagaaattgcaatctttcctctctctctctctctctctctctctctctctctttttggaatgaatcactttgtgtgattttgtatcaagattatctgaattttgcaggtacaatgcggttttcggcacggcgatggagcaggaagatgtcaaagatacgaagctggaagatgacgagatgtcccaattggttcttgagactgatgttgaattggaggataatccaggttgcttgaagatggggaggattgctcatgtgagtcaacagttgcttgctttcagtacactgattagcctcataattgtgcttatattctcttggagtctcaaattagtaccagcatgttttagacatgagacaaattatggtcactcattgcattctgataattaagttggtgtcaaggagacagctggttgagctccatgaattgtttttgttttctctagtgtggggacaataaaattttttgtctgcatttcgagttatttaagtgctaggcgcctaggcctaattcggtatctagctgccagtaaactgaacaccgtgtcttttgtgcctcacttgatttactcttgccaagtaagtacgccagtaagtaaatttggtttagaatgtgccaatggttttcaaattttgttaccgtttttctgaatcttgctgttcatatggttggattatccattctattggaagtgcactttctgtagaaatacataattttgtctttgctatcttcctaaacttaatatcttagcattctatccttatctagcatagaggaaacaaaagtattgcagaattcaagcagcaggcaaggattcatccgtgtagattctttttgtagtcattttcttcaaaaaagaaaaggattgtttttgtagtaaactagactagagtgtggctgcaaatacaaaagggagttatgttgtaaaaaaacatacttgcaatctgaacctattctcttagtgggacacttttacaatgattttaaatgcagagaaggtgaaactagatgcataatattcattcttggacctgaattatgatgggctagtctctagttataacttattaccaaaacatgcgaaattgggtcaaatgttgaattcagagtatcaaaacagcctttgaatatgaaacacaatttcaattcttaattctaatcttagttcagagatccaaacgggtgtaaggagaaacagccccattttgatataattgcgacagctttagagcctatgcctacctggtgcatttaccattccttgacattaatgtttgaagcatgctaataagttctgatgttcatttgccatagaagctgaatagttcaaccccgtgtaaatgtatatacccttgaagttatttaatttgtgcctgttttgagtagacagagtaacatggggctccaagaaaagcattccgttattcggaaagaaggcaatattccagaaacagcaccaacaccacggaaatcctattctctccgacttttctcgtgtcgtggagatctaaccaggaacgtcatcaaccatcctaagataccaaagaaggaagccgtgtctgtcgagaaagacctagaatgcagtgagctaacaatgaatctagaacgagcagtttccatggtatctagttcagacagtcttacgcagtgcgaatatgctgtgcaagaagttgccagagcatgttcaaatttgcgagaagatccaaaccttggaacttggctgtcatgtccatcctttattcaagggcttctcgaagtcacattcacttccaaggatgatctagtgctggagtgtgcaattttgattatcggagagttgattttaagcaatgaggtgaatagacagattgtacttaatgcagatccacaacttgaagttttcttgagacttctgagaagcaaagagttgttccttaaggcagctatagtactttatttgatgaagcctaaagctaagcaaatgctgtcattggactggataccacttgtactgcacatattggagtgcggggatgaggtgcaatttctgtcttctgtgaaatgtgctccaaaagtagctgcattatatttcctagatcagctccttatgggatttgacgttgatagaaatgttgagaatgcaaagcagatgattgctcttggtggtttggacctgctcatgaacagaatcgatggcagtgattcccgtgagagcaaaaaatgcatctctctcttgacgtcatgtatccaagcagatggcagttgtcgacactatttagttgataatctgaagaaggaacctattgttcaacttctagtaggaaatcagaagaaggctagttctgctgcccttaacttgctgagtgaactagtctgccttaacaggtacaacgattatacacttctgataaggtgtacaccgttagaatttttttagataatggtgcatactgttagattcatgtctactaaaacatcctttgtattgaacttgcttcttaacttcttaaaacagaacaacccagattttggagttcctcaaggagctgaaaaatggtggctgcttgaatacaatgcatattctattggtctatctccaacaagctcctattgcccaacatcctctagcagctgtcatgttactccagcttgatctcctggtaacatcttgaaagacaaatcttttcttcctttgccgagccacatgtttcgtatttgtacattccccatataacagtattcttgtagggagattcttcgcagtacagcgtttacagagaggaagcgattgatgccatggtagcagctttggagcatggttcacacagcagaaagttgcaagaacagtgtgctcgagctctcttactcttggcagggaggttttcatcctcaggggaaccgatcgcggaagcatggctactaaagagagcgggactagatgactccctatccgaatccttccggagaacagagatattcaaagataagagtgcaagggtggtacgttctcatgctaaaaaaaaactaaattctatagttcataccttataatttggtcttgaagctaggttctattaatctctatgctgtctaaattaccaggaagaagaaaagatagttgaagaacggctgaagaaacttgcgctcatgttgctaaacagtgggaacaaaaagttcctcacagcgctgtcaaactgcatatctgacggaatccctagtttggctcgagcgtgcctcatcactgtaacatggatgagcagctcactctccccgctgcacgggtgcaacacgttccagcctttagcttgctccattcttgcgactaagcttgtagatagcctaagctatgacagagttttggaagagagggtgcttgcttcactgtcactgttgaaccttgtgagacatccaggtatgtttcttttggtcatctccaacatgttcttgaaatggaatttcttaatttttttctcatacagtttcacactttctttaggctacaattttcaaacttgatacagtcggtacacagtcatttctgtacataaattttactgctcttgtgaattttttttaaaaaaaatgctttcagtggactattataaacttgtctaagaagagcagaacactgttgtttccatagccatgtaactaggaagctccatttctcgtaataagattgcatcacaatttcgcttcaagcctcattgttttaaggcaacctttcattgtcacagaatgtttggagaagctttacccactgaagaaagacacagtagagtcattgcaagatcttgcagaagtgacatggactgcaaaggagctccttttcgcatgctgtagatgacaaccatctgaagaggaacagtttctcagtctccaagaacagtgtttcaatatgggattagtgattgcttaattacacatttcttttttcttgatatgtaaagcactagagtttctttcccttgtaaagaagaatctggcaatggctttctttcatatgctgtacattgtgataattcgttcgttctggtctctgcttgctgtgagcaatctgataattcgttcgctctggtcagtgaggcctcttactacgacatgtgacacggtgaggacacacatcatgttgtgagactagaaaatctacggagttgctagaaatatggcgctatatgctatagtcgatttttttttcagccacttacacagtagttacaccttatttacaccccacttacatatgtaattagtatgtaattttcgaatttacatatgtaattttagtacttacatatgtaattttgagacttacattgtaaatacactaaaattacatatgtaatttagtgacttacaatgtaaatacatgccgactattttttgatgaaaagtatgacgccataaatatagctacacccaaagtctatattttctccaccaatattttaactatattttttagaaacacaatatgaatgcatgtgcatgcgcacacacccctatggccctataaacgtgtacatatacaatccatccttataaagcacatccgagaaactgatcgtcatatcttgagctacttttaaagatataccgagctaatattgtatttttctcacaaaaagtttaactttattttctctcctcgctccatatctagacaccgctaccaattcgcttgatctatctattctctccaccgctagctggtctaactcgctaattccatccaattcctgttaccagttctcctaggtttttatatagattgagatggtaactctaatttttaattttaaatgctacaataatttatgtgtgttttgacaggaaaatatgtagaaaatagctcctttcatttccctatcaagaaaaagcttttcccttgttcctactacatggagaagacacgcacacagtgcacacccctacaaatgtacaatatttgtccaactctgcaatatagcctattcgattaatcggagaatgtaataaaactgttagacaataacaagttaatattgtatacaaattgtgtggacatccttctctcctctccttccagaacccacctagcatgaagcaacttataaggtttctctattgcctaaaatttgaattttttttttcaaaccttctaaagtaattggttatgtttatagaacacttattatcatttgtatgagatgcaattgatgtatggaacaacattgtaccatgtatatatgaatagataaatgatttatttatttgtctaattgtgttttctattgtaatgatatgcatctaaatcaatcttctaatacataaattaagccaacagaatggcatgactagtcgttcaactcaacactgtgaacttacaagaactaggttgctaacatcgtgtcatggtaaataaaaatttagggtagtttcacttcagcatcatttacatgatcaatatcttgatatctctgtaattcggatggctgttgagaatggtactccaactctaagttcaatctattcatctcatcgtctattttagaaagtatcatcaaattaataaaactagttataggattcagaaagtgtcatctcttgttttgcttctctaaatcagaaaacagattccacacattgaaagtatcatccattgctttgttctaaccatctgatgtgaaggttgaagtgaagtaacataaacagtatataattgaggggggggggagggcacatcccccttcctcattttctcatttttcactctcttatcctctagtcaccgatgccgccgttgcacagtcatggaaaccaagattactgaaagatttatagaaaccatggcgatttatctcatttactcccaattcttttaccaccaaaggatagaaaccatggctatttttgggattgtctttatagaaaccataacgatttttcttctccttcactctgcaaatccttcagtctctaacaggcgttacacaattatggggaaatgagtgaagctgccattgactaatcatggggaatgacgactaagaccacgagtcattcattttttttccttatttactccagtcctttgccattgcctagtcatgagaattgtgaccaagaccaccaaaggttctatcatcgagatatttaactatttaccattgaactcaaatatcatatatacatcatgaggaggtccacatgtcattgatatactccctccattcctttatagatggcagccatgcctaatgcacatatcacaaggcaataaactgttgatctggataattactaaaatgcccctagctctagatagaaaatgcaatgaccaggcaccaaaatgtgtctaaccatgagaacctaccgggctgctcaaatcccagttgagatgaatggagaaagatggagcagactatagactcttcttagggtatgtttagttcacgccaaaattagaagtttggttgaaattagaacgatgtgatggaaaagttgtaagtttatgtgtgtaggaacgttttaatgtgatggaaaagttgaaagtttgaagaaaaagtttggaactaaacaagcccttagtgaaaatgaaagactttctgattggacccacaaagggcaaaattggaaaatggcatagtaggaatgttgcagtgccaactattttggaacaaatgaagtagtcatggctgccaactacaaaggaatcgagggagtatgggtgaaaaatagttaaatggttgtttatagtgtagctaaaataaacttaccaaattttagcagcgccaaaattttggtaaattggcaatattaccaattttttttaaggatttcctatctatttatcaaagtttggcaagaaactaagtgtatacacatctttggcaacttttttaaaaaaaaagatcctcatcggtaagtatattcgtaggctgatcagccaattaagcctttttcaattcaaacaaagccattccatctgttggcttaattgattaatttgctggacgaggaatcttctatgtctggtgcttgtatctcctagtttgtggtattgggatttttatcttctagtatgtataaccactagagagttcacaaattagccacccctaataatccaacttacttgtgggtaatgatccaacttacttgcgggcctcactgtgtttggttgataagcctaagcccaagcctcagccaaacaagctatccgataagaccttggtatgtttaaaatggcatcaatcttaaccgcccctaaatgccaaataacattacagtacaatcttttaattttcaaaaagaaaaaaaagtcaagactaaaaatgggctaattaccatcttacccttcttcctcctctctctctctctctcttgcttccatttttctccttccttccttcccgcacgcacgcacgcacctaccctcctccgccatcgatcgtgctccgatctgcgccgccgagccggacctccgcgcggcgacggcggcggctttccggccggcgagagggccctcgtgggcggcacgtcgtggaccacggcccccgcccagcgttagccccttcccccctgcgctcgctgggtcctttgctcgatcgcttctcgattccccgggtcgcctgcgtcgatctccatcccgcggggacgagcagctgcgccggcatccgctgcttccgacgcatcctcgcttcgctggtgagcatccaatccgtttttttaccccgcacttgtcgaatttgcgttagccctagcttgtctggtagatctggaatccgcttttctcttcgccttttgcgttaaccctagtacgtactgataccagtttagttttgatcccaggaaaatttggtgggccctgaagaaagtagtgaattctgattggattggttgatttctggttcatccatcctaaatgtggtttgcattttcagggagatatgtgtttgtcatgctcaaaatgaggtggtaaggggataatctacatgcaatgctgggtggtaaaaaggttcactctaggagagattggtttaaaccattgcttcaatgaacatcatactagaactcaaccatctcaagcaggtcagcttgccgacgcggcctgtcgtttgcaaaggcctttttatagtgattgcgcttattgtgctgagggcaatcgtatccccgtttctcgccgttaacccgtccgagaaggagggtttttacgatccgacagccgatttgctgcctgggattaggcgaggcaagttcattgaggttccacagattatatggggattgaacaatcagaagattgcgtttgccagggcgtgcttgactgcgagattcctgaaccggtctctgctcatgcctagtttgagtgcttcgcttttctacaaagaggttgacttgctgcgaccaatcactttcgacaaggtgtttgactttaccaagttcaacgcccgttgccaggggttcgtaaggttagctcgctattcagaagtttctaatcaaaccaagcctttcaaactccaaaagggaagtggtaggaggtggaccgtggagaaagacttggatcagctactacagtacagaaggggtgaggcagatgactctgaagtcattgaaatcatcgggaaacatccatttttgtggcctgatcactggccagtgaaagactatgccagaattttcgattgccttgcgttagttccggagatagaaactgaagtggttaaggccatatccaagattagagaggcaggcataaaagcaagacatgaggctggtatttctcataataagcacgtgaaagatggtacaatgaatccaccagtgccatacattgccgtccacatgagaatagaaaaggattggatgatccattgcaagaaatgggagcagcgttccaattcaaaggaaatttgcagcagtaaagaagagatcattcataaggtctcacagatcactgatctacgtaggccagttgtggtttatcttgcagtagctgacagccttctagaagatgattcaataactagcggttggagggtgggtatggttgcttttgagaagaagagacttggagttactgacatctacaataggcaaccttatcttataaagtccgctattgactttgaggtatgtgcgagagcggatgtgtttgtaggcaatagcttctcaacattttccaaccttgtggtgctgtcaagaacacaaaggctatataacatgggagaggcaagctcatgtggagagaatgtcgggctttcatcctatgcctacaatgttattggagacgatggcgggccacagagatggatgacagatatgtcagacacaagcctccaaaacttgagttacggaacgaacaatatctcatgccactgacttatgacataaaacacttgactgaacacgatcacacacacaaggataattcttgggagaattttagctacaaacagaggaacatgttagaaggttgatattggctgccacacttgagagagactttggccaagaattgtctgcagacctttgtgagtgtatacaaaaactgttctctgaagaacattgacttgtattgaacagtctttagtttgtaaagttaaatgttgtgtgttactttgtcttcctccgtaacttttaatgttatggtttcaaaagagcagcttcatactggaatttgatggtgtcacttttcgcacgcatttgcatgaggtgtatttatttgtttgcagtgttccgacttaacaaactcttgatcacgagtactgtgatagcttccctgaaatattctctttgggttagtattgtctcaacacaacttagttgaaatcttactgtggtaagaaagagggctggttgatccagattgatttaactttgaaaatgagcaatattcggtgttacagaagaaaaaacttattttggcccattttcatcaaggataatttagaattgagaagagacgagttggaacttggaactcgaacaatagtctaccactgatacttcaggtttaactgtagtctatcatcttaaagagaaggggcattttgtttatttgatcagacaaagtatcagaatggcatgatcgagctgttcttccagtgattctagcgtgaatttctgtagatgtttttttgtaacataaattaataaaacttgcatgtcgaacctttttttttacttgaattgcatgttgaaacctgatgtatatatttatacattttgggatctttccctcttcttttttttttttactgaaacaggccttcagaaaaggagatgaacaaacagcatttcactgtacataagcttacaaagtttgctcccgagttacaacttacagcatcagcaatgacagaaaatgagcgaagtgaaatgaagttacagctgctactagattgagtgagaagaacaatggcaggtacaattccaagaattgccataggctatctacctacttagaacagccagtgcttctttctggtcttgcgatttggaagatctgaaagtgaagaatatattatgagcatgagggaactaatcattaatgcagaattatcccagcagaaattgctgaaatacatggatagtagataccaactagcagaataaccacaccattatttttttcccttcaaaataacacacgagtagtgcgtgtgcgcaatgaaaaacgaatagaagaatagaaatgttttgtgaaaatagcaagtagggaacctttcttgcccgaagagaaagaaggtacagatcacagaaaacaacactcaccttcagttgcatacaaggaattgtagtgcacctcactccagaagcttaaccaaagctctgcagaaggaaccaagggaatgatcaaacaccaaaaatatatattgggatttacatttaccaacccatgcggatactgcgtacatggatttagtttgctaaaagcaggcaaagatttacagaatgaaggatatcacaagtattgaataatataaaaaacatcatgacaacacaaaatagaaaatgtgacctcaaagttctcaaagatctcaaacaagatatcaaagttctcaactctaaccttttgtgggagtggcacctctggggactatctcgattaggcatgtgtctctaaatgatgtcagcaggcaaatcttggcagcaaactaatttaacagataaaaccgtgttagtacatgatgcctactaatattataacaatggagtactggcaacttgttattgtcaaggaacatgattttgaaaacatgttatttgaaatttcaaaatttagagagaaatgtgaattgcaggcttagggattgcttaatcatcaggagtataatcaactaaatatgaaaaacatggtgttgagctgttcattgagaatttgagaagaacggagatgataggagatggcacttgtatcttttactcaacaagaatggaacagtaacgtaaatgttttcagaaagatcactatactatagacacaaggaaccaataatggaaaaaaagaaccccatcatccaattccacttagaaaattatagcacaggttcctctaaaaataatagctataaaataaacaaacaattttttttagaacaatatattgttaggttacaacttgacagagttttgtgaacaagaaagcatcggattaaactatcgttagaactaagtcacaagataaataatgtcaaaacctacagttagaaggtattttctcataacaaaccaatcagccatcttgaaagtgctatgttacccggtctgcagccgcttgtaaggtcacatgatctccccattctccagatctacaattgcgtaaataaaatgctttaaataaggacataaacagcaagttaaaagttttacatgacaggtgtgttgttgttaagaactagaaccttttcattttcttcaagtacaccttatattccatcggtacatagccttcatagtgtttcctgaattcctttagctaaaccagagagatagtaattcagcatagaacatatcaagaaactagattgatgatgtaactaagttagagacttctttatttgcaaaacaaacaagttttgctaaggaattagtgaaagagttatggaactacctgcttcacgactgacttcctcacatgtttgtgatagtcaggattgcggaatatctgatctgccaaagctcggaactgtaaggggaaaacacatgacagaaataaggactggttggagacacacatcgaaaacttgaccttgcagatgaactgaaataggatcataacactcttttgaaagaggacattatggaaatatatcacgcaagtttatacaggaaaggagatgtgctagattattatagtaactaaattcagaataaatccaaataatataatttgccgagaatatcatattatacagtcaataatgagatagatgacttctccaaatgtagtagaaatgccttttaaatagtttttttaaattatacctatggtaattatacaagcaagtaaaaaaatagtaacctgacaatttccgtctccttcaatttggaattcagctaagccataagtgcccaatctgagaaaaaaaaaagaaagtcaggtaaatgaaggagacatgaatcagggaaaaagtaaagaaaacaacacaaatacctttccagtaatgtttcatggtctattgttgcattattaacatcaggaatttgcccattaactcgaggagtgtgctgccaatgaatatatcagtaacttggtacaggggaattagcacagtagcactataacttgcagagtaatcatggaggttatatggagcatatatcaaaaatagtatgttcgttactaggcaagttctcatgctagatagctaaatagccgaataactcccgtcaaagacaccaaaactatcaaaaaagacatattcaaaaaaatagactagtaccgggatagaatctaagtgggaaaggcgttttccaagactccgtccactgttctttgcttcagttaaaagggtaccaactgtcacatcctcctcactctcctgagtactggtgctaagacttgagcaagaacttttgctagcatgatcctgttgttcagacatgctacctcagagggagcattgaaaatatatggattggctgcaggttccaaaggaaagaatcagtgctgcaatataaaaaaaaatcaacagttaagagcatacatttgcataataacatggacagtaagtacaatattaaagaaactgatggcaagtactcctagcaaacagcaaagtgttcagacacaacactgaatggcttctatgctggaattacctacctaaatattctaatatcaacattggagcatacatattacacagctgctagctcaaaaaaaaaaacatattacacatctggctccaccagatgatttcttgtatccagcatatttgttgcaaaataaactcgctgagctacaaatgccattgattgtctcattggtataaaccagtaaggacacgcaaagaactgaagtagtagaaacgatgcaccagaatgccagatgataaggcaactaatttccaagaaaacgagacaattgtcaactgggtaactggaaggcccgttcctcacacggcaacactactaatcaaacgagataaatctgatattttcagagaagcaaaaatttcacacgcctccttgcactaccgatttactggaggaaactacgaactctctgaacaatacccaagctttagctaaccgtccaagaattataccacacaaaaactgtaccaatgaagccatggatctgagcttgcaacttggaacggactccctgaccggacaaaaaggacacccacaaaattaccatttttccgggaactacaaggcaaaaaaagttgtacagatgatgggtagacctaacattggagcatgggagttcaactgaatccccaatttttttctttttaacagaaactgctagttctgctacaaatacaagaacaagcacgcatcaaagaaatccagaaaactagaagggttaactgaaaggaaccaaccaatccaacttcaggtggctatcccgcaccttgctggttcttgccggccgcgcgcgggaggaggaggagctctggctcgcgcagcagcagatcggcagcagagaggagaggagaggagcgcgatggagaagaagatgcgggaaagaaagaaagaaagaaagaaagaagcaaagcaaggcaacagaagaaaatggaggggaaggagggcattttggtcattttaccttttttttttaactattctcctaatgtacttctaggagtgtttgactggttgcaagttgtataacttgcactccaaatgtcaaatttggtgatccatcagtagagtcaaagcaacaattttgcaagggctatagctttgcattgggatttttatttttattttttcggggatatgcaaagtgctttttctttaattaagattagaaaaaaaagtgattctacagaacaaagtatgtaaaaaaagagaaaaggaggatggtagattaggaaggccgattatctcacaaaacattatgtaacgaaggagcgctccatctagatggacaccttgcttcacgtcagagggcggcttctattgtcaccatctctcctacttcctgcattatttcgcacttgccattaaaagatatacttcctccgtaaaaaaaaaactcaacctaaaagggatgtgaataaatggtagtccagattcattgtactaggatgggcatcccatcgtggttgagtttttttagatgaagggagtagttgtttcgtttcttcctgctactttctgcattgttctagagggaagatttttatttgttttgttttttaagaaggacctgcatttcttttccctgtaaaatcatggtattttttttatatttggagtaactgtatatttgtacgcatgccatgtgtgttgcgtgtgattgacaatgttccatgtggttcatttccaagatttgtttcgaaccaacttgcaggtagccacaggatttcacatcagccagagaggtattttgattaaggattcttgatgctaatgcttttaggacacttcagagaaacacactgtgtttggtctcaagctgcacgaacatggctaaattatgaaaagcatccacgttttcatttttttttaaacaaaagaaaacgattgaatcacaattcacaaccaaatggagaggaaagaaaatctaaaatcagtaccggtgcacactgaacagaatctctatcttcttttttgcagcatcgaagaaggactactactaattatttgtagttaagagtgtactaataccaaacagcatgtgttctattgtagaggcatctctcatttaatatttactcttcaagagcaacaaccagccagttgaaaaaggcattagatgatgaaatgcagacatgatatgatcatgtgaacaaagaatgggagaaattgttcaccactgatgggaaagaaagccttttttactgcactgtagggtgcaaaattactccctctttgatccatcaaaagccaaatttacatcaaatttgaattgcaatcaaagcatgtgtacaacttgatttctggttgtaatttctttctgtaccacaaaatctgttataatacacctgagtttgctcaaggaatggagaattggagaccatcactatgttttcttcatattacagaagggattgaacagaaggatgatcagagcttccttgagatttctatcagggtgttgatcaatctacagccttggcagtgctgaacagttatgaatgctgccttatgctgattagctcgatgtcgaagatgagtgtaccgagagtggaaccctcgccatttgccagacgtgttgggttaaatatagtagtaaataatctctgccgatcaaagaactgcacacgaagcagcagagaaaagtttagttttttttttccatagccttctcagttaatccttcaatcgtagataaagaattaaaatatgaacgttcatatgtctgcgactctgcattattaaggaaaaaagggacaacttctaggttagttttgactatttgacaagtccaactaataaagaacatgtagaaattgcctaaactgggaaagctttaattagttaagcaaaggtggcccagaatagaaaatagaaatccaggattcttgatagcacgagactttgttagaacaatacttacattaggaggaatgggttcttgtgatgtgttctgatatccctgtgacggtggaatgatgacacggcgaagaccaccaactctcatggacttcactgctgcttcaataccaggtataacctgcaaatctcatgcataagatctaggcaaatcatcaccaccctgaaacattacaaaacaaacatcccaagaaacataccggagggatgacagataaaagggagacattgaccaagttgacaataccataaaaaaaatcgcaaggagcatctagaatcttaagaacagatggttttaatgggctgttaagtgagttttacaaataatatgaactgataatagaccccaaatcaggatataaattaccatcctaaaatcaaacctacgcacatcatagcctcataggatgatgtagtttctcttctttgttacttcgccactggattttttttctgcatatgaaagcatgaacctcttctacttcactgataacatgcgtgcacttgtgagttgtgagtcaattacactattttaaagtaccgaagttaaataatgagaaaatatatcagttgtctgaataattgacgtttcaggaattcctttgacactgctcccacgtcatgttacttttttatgaacaaggtaatatcaaaatattgtaactgcaaatttcagcaagcaacttcacattggaagtattcaagatatggcatataaaattgcagactgtagtgtagtatcagcaatctatgcgattcaattctttggaaaggaagttctgatgaaaatctcgtgagttgtgacattatctcacatttccagctccgacggtgaatacaaacggcatcggatcaccggtctcgtccttgtgatcataggtggaatcaaagcgccatccttgcttcgctgccaatcttccatagtaatggattgcaaccttcatagttcatatatacaagtacacataagaaacttccttacatatttttcacaaaaaaaaataaattatctgaatttcaaccacacattcagacagatccaaacatactggaaataccatcacattagaggaagagattcatcataagaagcgaattgaatccattaataccatgattatctcactgccaagtactcctactaggtatgcatttccaaggtctccagcctctccactagcactaggttaatcactttattttgcgcagaaaggcgccggctttacctggtcgccgtcggccgggacctcgccgggaccctcccggaggtctagggccttcacgccgccggagccggggatctcggcgaagctaggggcggcggcggcagaggcagaggccgcggccgcggccgcgggcagtgtggaggcagcagaggcgaggaggaggtgccttcttgggatggtcggggcatgcgcttcggctacggcgaaagcttgggctttttgaggcggcggcacgacgccggcggccggagcgacggcggcggacagactgaccatggagggtcgttggtttttgcaaatcttttttttccctagtttttttttcgttattaattcttaggctatcttcaaaatggtgctttttttaaaaaaaaaagtttctacatagacttaccgaggtttcccctcctctcctctggatacaaatttagcttcattttggtttgacgtccctactaggcctaggagacatttgaagcgcacgttgagaaaaaaaaaagacagtcaagaataggtatgaattgagaaaaaaaaataagtattgacaagcgctcaattctaagaaattacatcaataaatggtgagcttcatgcaatgtcattgtacaagtgactttgttgtaaaaatatcttcgccgctagggtttcgttagcagtgcaccgttaagtgcggtaggatgaacaatacatttaacgatagcaggatggatcaaaccctaataatgatagcatttataggataaaaatcgtttatacaatgatatttcgtggaacccgcacctattgatgatatttcttggactttggtaatgatatttcttgaattttctcttatagagatataagtaatctctccatctcaaaatataaccacttctaacattcaaaatttatcctaaaatataattatttatcccccctatatcttctcccaactaatcacaacctttcaccatttaaattctttattaactttctcttctcaattaatcacaatcttattccatttaattctacctataaacaatatgaaaaacaaaaaacacatgaataatgactattagaatcccagtcttttttttcaagggaccaaataaaacaaatttccactagaatttaaatcctgtaatttttctatattttccctacaaatcaaaggtccgtaagctttttgcaagtggtatataagctctctttgtattttcatgtatgttttgatgtatcaagctcataatgaattttaacatacatttgacctcatacattcacttaaatatatgttgagctaaaccatataaattaccacatgtgcatactagtagggtccgtttgaaagctagtttagcttttgcttcttttttttttcacacgccaaacaagaaatactattagtgtattattaattaaatattactgtattaacgattacaaacttgagaaataggtttttttttgttttttgtctaaaaaaatttctacatacaaagttctcttttaataaaatgtattatttagtagcttaggaagctgcttacagtaaaagggtgttgaaaaggcgaatcgagcaaacaaatacaacctcacatgttacacgtagcaaaccgaatatcatataaagagctataactattgtttcaactcccatgtaaagcttttagaaaataaaatccaatgtaaaatctaaatttatccattgttaacataggctgtatttaattcccttcaaactttcaaaaatttcgtcacatcaaatatttgtggacgaaaaaaaccaattgcacagtttgtatgtaaattgtgagacgaatcttttgagcctaattacaccataatttgacaatgtggtgctacaataaacatttgctaatgacggattaattagacttaatagatccgtctcgcagtttacatgcgtaatctgtaacttgtttttctcattagtctatatttaatacttaaaatatgtgtccgcatacgtcaaaaatattttggccaacaactaaacacggccatagaccttaaaaaaagtgctaataagccacaagtaaatctggctccctccaatctctcatctccttctccctgtgcttcagctgcagtagcatacaggaacttgttaagctgcggttggccaatccggacgtctcacattatcctcatccatcccaacacccaacccaagacagcataaacacaccccagcccagctcgactagaatacgagagaaaaatcccatctttggtctcctccccctccctctcgctcgcatcttccccggagatgccgccgccgccgagatgcgccgccaccaccgcccaccactccctcctcggctcgcccacctgcctcgcgcgcccgcggcggcggtgctgccccgtgcgcgccgccgtcgccgtccaggccgaggcgcaggccaaggtctcgctcatccggattggcacccgcgggaggtgatcgcaatcgatccaaccctttttttttcttctccttctctaattctgggtgctgctcgtgtggataagcggtaaaattcgcgtattttaggtgctgaattggtttggatttggggtcgcggtggctgcgagatcttgttttcctctgggaatttgggtgtttgagatgtggctctgacccaattgcgtcgttagatgtcaggcattgcgagcactggtagaattcaggtatagagaattgaggccgtttaccaagatatgtgcctttagcttcgttttgatggaattttggatcagtgataacatgccattgttaacattagtagtgctaaagaatagacttttgttcagttggcaaaagttggacttttagatgtttcccgtacgattgttggtcaacacgacaggttgtattgttcttgcgctttatgagctagctggaagttacatgtgattctttgcacgattctagacattagatgctttttttttctgattttaacttggatctcgtgtaaattttgcatccacattaaactcttatgaggaattcacaagaattgttatggttgctctcttttcaatattgacttgaaagtgactttatggttgcgaaaaagggactttctttcttttctttgtttttaacaattttttcttgtgatagagtagcttatttgagatatgcaagtatgtaattcaaattattggctgtataggacagtcctcttgcactggcacaagctcatgaaacccgagacaagctgaaggctgcacactcagagttagccgaggagggggccgttgagattgtcatcattaagaccacaggagacatgatcttggacaaacccctggcagatataggtggcaagggtttattcaccaaggagatcgatgatgcacttttgcagggaaggattgacattgccgtccactcgatgaaagatgttccaacatatttaccagaaggcacgatattgccttgtaatctcccacgggaagatgtgagagatgcattcatatgcttgactgcaagttcccttgcggagcttcctgctggcagtgttgttggaagtgcttctctgcgtagacaatctcaaattctctacaaatatccatcactcaaagtaagtacaatgaccactttaatgacagttacagtatgcgttgtagatttctattgtgaaagggtggtgttccatttcaacttcgtaaaaatatgactagttcaggatatgcaatgctagattcacattggttaatgtaggtctaggttctaatgttagtgaatgcttttcaggttgttaacttcagaggaaatgttcaaacacgattgaggaaactcaaagaaggagatgtccatgctacattgttggctctagctggactaaaacgcttaaacatggcagaaactgcgacatctgtattgtcagtggacgaaatgcttccagcagttgctcaaggtgctattggaatagcttgcagaagcagtgatgacacaatggtagggatctaatgttttaatttgctagtagattaaagaaaatcatagagtctgcattcataatgccatacccaaatctgaactgtgctaccttttaattctggtaaggtgacaagttcaagcacctctagcctttttttttcttctgttctcagctgtggcacatcatgctgttaaaaaatgacagatgattgttcacaaatctgatgaccttgtcaaccaacgcttcacattttcatttacctactccagccttgatccatttgtttgttgctctttatcctgatcatgctgcatattttgaatattttaacacctgatagactcaaaaataaaatctattagaatattcttaatgcctggcctcctgtacagctatgcagaatgtgccaactgcttgcatgatctgtttcatttttatgcactgaagctagataatgaggctcttttgtccttccttctgcagatgaattacttgtcctcattgaaccatgaagataccagattagctgttgcatgtgaaagagaattcttgtcagttcttgatggcaactgccgaactccaattgcggcatatgcttctcgtgacaaggatgggaattgttcattccgagggctattggcttcacctgatggatctacaggtacccttttttgttcaataaaatctatgatgatacaaaacagctatattttatcatggaattaaaatgttttcttttttttggtgtgtgatgctgcttacagtatatgagacttcgagaactggaccttatgatttcgatatcatggttgagatgggtaaagatgctggccacgagctgaaagcaaaggctggccctggcttctttgatagcttgcaatgaaaatagaaatccaccattggccaactagagtgttgagtggattattttgatttttttttgtaccctagttctactagaggattgtaccacaatgttgagctgtctcattcagatctgtatctttgcttcttttagcaaggtgagctagaatttagaacgtggttccacggttattgtaatcccttgtatttccaatgaattctggaagaggcttttgcggccaattatgttgtaactttgtaatttgatgtaattttgcagatgctttgttttcaaaataatttgattctgaaattgttgattgttgtactttagtcataagtctggtttaacatacaatctgtcaaccagagctgaacgcaatgcttcctgatacatagcactcagatgaaatatagcatatgtttagaatatttgaacaacatattaagggatgatagtgttttcccccaaaacattacaacacgtcaagtagagcgtacagtctggatcactgttcaaacattacaggttactgacatactagtacagagtaaccgatgcaggttcagagtcctaagctaaaattactcaaaaacagtactagaacatttgatgcgaattttcttgcatgtaacataagcctggtcaccggaagcagagtatccggcattcaaattctcacagctactaatctctgattcagttgggacttgacactgaaatagtagattgcttgctagattggttgatagtcaggatggttcagctgatggaaactactgaatagctagtagcttttttgttacaaatgctgcagtcatatcatgtgaaattgcagcttcatcatgtcatgaatctctgttaactgctctgattctgcattgcggacatgtaagccatctcttcagcggtcactggcttgtgcatctggatgaacagaaaggcaaaaactctagttagacaatcgtcctttcagaaaataattacgatgtcctattacgtattaccatgtcaaatgaaaggaagattggcaaaacaaattaacaacatgttcatcaaatgtaagacaagcagaagaaggcgttcgtgaaaaaaacgaagaattaaattttacagaaaagaatcaaacatcactgcatctttttgtttaaaaaaaaagtgaggcattggataatgaaggaggccagcatgtcattatttagacaagattgagaagaatgcaacttgaaagatgaaactactggtgatatatagagcatcaaacgaacaaacttcaccaattatttctgttatgtccctagcttaggtggtttgcgtaatccaccgaaaaattgagtagcatacacaagcacaacaacaaagcgcacgaactgaagaaatgatcaacaaatcctgtaaaaaagaaaaaaacttacagcattagcaacggttagcaaatgaaagcaccgcggtaggggatcctctgccgatggtgtggtatcatgattccaatatgttatgttttgaaactccgcacgggatttgaaattgctaacctccccctccagcttcttcatatcctttcctccactcctcttctccaatacataacctacacaagaattggtagaatcaccacgaacttgatcaatacataacctgcacacactcggttcaacttacacttgctactacagatcatcatgtcattactagatgtgcctagatgtgtaaattacttggtacaataccaaaatctggttctgtttttttttctaaaaaaaatccaatcgttgctgctgattcgtaatttgacgcacatttatatgaatcgattttaaaaaatgaatcaaaccaatgcaagaaacacacctcggtagccatccgggagcgagatggtggcgccctgcagcttcctcccgcggaagaaggcctcctccaccctaatcccctccacctccacacctgcgcgcatcgattcctcaaccaaacggccaccaccaagaagagaaagactgagagatgtttgcggcgaggcactgactgacctgtgtccttgggcttgaagtagtcggagacggcggcggcgccgttctgcttgatgccgcaggggaggaggtgcaccctgccgaggtcggcggccgccgtggacaggtcgacggcggccgtgacggcggcggcggcggcggctggctccatggctcgtggttgctgactagctgtggtcacactgagctaatgggccaactgggctttttttttcgctataagcccatctaggtgaacaagtctctctctctacatggagcattgaacgtgttacagcgaaaatccgaaaaataaacagcctcatcttttcgcttatcgcttatgtttatacttatcggccaaaatttaaatttttaacatcaaatttagagttgattttgaggttttttcatctaaatttagagttgatatatgtgatgccctatatatcaccagtagtttcatctttcaagttgctccatcatattttaagtttgtttttcaacctttgctttttgcttttagatcgataagaacacatatataaaagttttatttacaaattattttttgttagcaaatatgcccaaacgatggagccaaaagataggcctcgttgttgagagttcgaacgtgttatcagttactccctctttttatgttttgatttttttccttagtcataacttattaaagtttcatcgggtttatagaaaaacatagcaatatttttaacacaaaacaatcataccatcaaaatatattttatgttagatttaatgaaactaatttgatgttatagagattgctaaatgtttctatagactttgatcacacttaagaatgtttgattagaaaaataaaagtcaaaacattttataacatgaagcagagggagtttcacgctgttaaatggaagaaaacagtcatggtacaatttcagcttatttatattccacacctatgtgttctttttacattcttgatgggtcaatatgtcctatctatgtacatttcatagtagctgaatcacatgatcatacaattctctccaactcataaagcttcataccagctaagctgtgtatcttctctccagctaaaaaatcctcgtagcaggtgatttgataaatccccacatgatttggcctccttaacccacatcaaaggagtgtttactgccaggagcactgtgatattcacaacttcaaattctagttgctgtctaccaatctttcattgccgctacaaaagaaccaaattaccaagtccatctatgcatatcatgcaagctggtggaaaatattgattgataggaacaatgtagatgatcagtttgtccagctatctgtcagaggagatggcttcttctattctcctgataacagtgctaagactatgtccactttccagtgctttgacggcagctctatgcgctttcttgtgccatttcaagaggttgtaagattgcatgactgaccaacgagctcggtttgccatctgataagcaaattgagaaatatgtgtttgactacatcggtttcaatcaagatgagataaaagattaagaaacagagtgatacaaacctgagcaacagagagtgggggatccagaagaatgcacaaactcctgaacagattctcgtcattttctcccccttctgcctcgccataaacgagtgcttccgcggcaattccagcaaatagaatcatacaatatctgcaatttaagcattcgaatttagcttagatgaggaagaaattatatcgaagaactccaagtaacgacattcaagcacgatacctattttcagtacctgtcaaatgctgtgcttgacagatggccctcagcaagttctttttccattttttcatcccagaactgggtccctgcctgcaacgttagtatgaaacaccgccacttcagttctaagtaacatgtgaaggtctacataataattaaacagcatagctcagatcctttggaaataaaatggttagaatagataacccatctctacagggcaaagcaaagagagagtctaataatctactaacatggtagaatatcaatatattttcaggacaactttaaagcataatccagacagaatgaaacataccacctcatgacaactcactcttgtttataaacattcccggaggtacagaaagcatgaaatgtggatggaatagctactacttacaaaattagccatagtcactgatggcaggttactatttattaaaatctgataaagtggtaatgccatgtagcttacacgccttactttacttctaatattgaactcaaatcctagagcgaaaaagggaactgttgattgctctgtcaatatgatggataattaatcaaggagaccaaactctattgcagacctttgtagcaataaggtaatatatgaagtgcaaaaggtgtaagcccacaaaacaaagagtagcagaatacagagacatgagtgtttagcaggtacaactttctcatatctgcctgtgtggatttacactttctcacgaaagtgatagcatgagcttttataatagaaacggcaagttaccgagtgaaatcaccagaaccacatcccactaaaaaaaataaagggaaaaaaaatgaaaaaaggccctggaaattaagtgaaagaagttacactactacatgtagataattgacaagagaataaaacaaatgtaatagttatccctatacaataaaggaaaactactgataattgtacctggccttgaatgcccattcgtaatgccacaaatggatctaaaatgactcctcgtatggggcaacccattagataagctacgtgcattcaaagtgagaagtgttaggtcaacagaatagaatctcatgagtcagaaataataaaaaccacatacaggaaaacgaaagaagaaagtaccaatctaaagttttgtgttagtcacatgaacttgagacagaagagtggaaaaggttctaaaggagaataataccagtaagaagatggcctgcttcatgtacaaggatccggcgcttgtaaggaggccaaaaacatgagatttgagcaacacaggtaccaccaagaaacattgcatctgctgctactaaccccaatatggcagccaagttagcccgtacatctactccttgatttagaagataagatacacctccaagaaatccaattagaacatacgaagaatttcctgagagaccccacttctttggtgcgagctttatagctgagaaaagtaatcaaagaaaaaaaaatgagagctctacagaatacagccacagttcataatagaagaaagaaaagtcccatgaagctgctctatcacatgctgtagttgtgttgctaatgactaataaggggtattgcagtatgcatttgttaggaaaaagaagtgtggcagttcatttaaggactccaatccaatactgtctgaaaaaacatccatacgaaatgggatgctattgcaactctcaccttccaaacctgtcatctccttcaaaacagttggtgtgacttctcttggcccttccagaactgcaacaaaaaagaaatacattcacggtggtcagtgtaactaacaccaatgccaaagaaagtctgaattatatggtatcttataacaaaaaaaatatccatataaactctaaatgcaagtgagattgtgggatcgagtcttcaatacaagcacatcatatcatcaattatcaatcttagggtgccattctacaaccatttgctccctccatttcatattataaatcgttttgactttttccctagtcaaactagtaaatttgaacaagtttatagaaaaaattagtaatacctataatacaggagatttgaactcagaaccttggggtactactcaggtcactataaccactaggctatatgccctttcgtatatacaaaattagttttatgaaaactaacatttacattttgatgatatgtttattttgtgtcgtaaatgttgccatatctttctataaactttgccagacttaaaattgactagaaaaaaaataaagcaacttataatatgaaacggagggagtaacaaactgaatcccgcacccaaattatctcttaaattgcaaccaattcacattttaggaccctcaaatcacgcaccaaaaatgaccaacaacaatggaaagcgaggcccccgcgactcgggcttaccgatgttcttgcacttgccgaagttggcgaggaccccgcggtcggcgaggaactggtaggcccgccccacgagccgcatgtcgtcggcgtcgatgcaggcgtcgagcacctcccagtccctcccggggggcacggggagcgccacccgcgccacggccgcgcccgccgccgccgccgccgggggagtctcgacgtcgacggactgcaggaagcggagcgcgcgggggaggtccctgctcctcacggcgtcctcgaagtccccccactccttgagggaggagcccgcccgtacgcggaggcggaggcgccgggaaggcggggaccacctggagggggaggcgaggggaggggagaaggaggcggtggtcgccattggtgagggtgcggaggtgggagagctgccgcctgtggcggatttgcgccgctttctgaccgacgagatcacgtgaccacgacgatggtttacatgggccgggccgacaaacttggccctcgctggccttttggcccatctattcggaacatacttgggccttgagtccaacatagtaggaataagttcaccagaggtacctcaacttaacagcgagattttttaaggtcccttaaccacaaaaccagaaatctccacccctaaactaaacaaaaccgttcactcaaggtccctagacagtatatatgggtggtttcgctgacgtggcatcctagtcagaaaaaaaaattaaacaaaacacgtggagcccacatgtcagctgcatgcctgcatatcttgttttcatctcttttcttctcctttctctcttctctcttctcttctccctcctcctgctgctgctactcccatctctgccccggccgtggtacacgagatccgccgccgccgccggagtcctcgtcgtcgctgccggctggagagtgtgctgttgggggaggtcgcgccgggctcctcgtcctcctcgctgaagctgccccccctcgccgtcgtcgtctcccccgatggggttggccagttcacgtcgatcccccgcaggaatggcatctcgacgtcatggcacgccatcatcgccgtcctcccctgaccttcgtaagatccatgcacgaaactgagtcgccaagattgcaacatgcatgcacgcacgacatcgacgtagtccgtccatctatactcaccggaggaggaagaggaggagaagaggccggcaccgccgttccagccgcacagctgttgcagctgcggggcggcaccacgggaaggctcgggtgaacccgagcccgggaagcgcgcgcggatgaggtcccacgccaggtcgacgtggcggtcgccagtggcgaggaaccgcctcgtcccgcgctgccgccgagtcagggacggacgcggaaggccaagtgtctcctcgtcgggtgtgggtgctggtccacgagggcgcggttcctggagtccggcgccgagcacgacattgtcgtcgcactggacggtgaggcggaggcatcaatgctgctgctgcttttcgctcaatcagatgattcaatcacattcactgctactttccgtaaaaaaaaacattcactgctactcgagatcaagacttggcactactcatcgattaattaacttgtactcaagacactgatactgatcaatcaatcaatcaatcagtggttagtgctcgtccgatatagaaaggcaaaaggcgtaggcaagaacgaggagaggacggacatgaggttgcatagccatcagaaaaggaaaagagacgggagagagagagagatcacggtgatggccggagatgcggaggatggtgacggcgagagggtgcagctgttcgtcggccaggtgcccagctgcatggcggaggaggagatcctcgccgtcgaggcggccacggcgtcgtgcacggcgatggacagcgccgtctcgtcaagaggaagatggctgggccccgcgggccggatgccgccgtcgtggacggcgcgcagcggaagcacgccgccatcgccgctccgcccgccgccggcctcctcactgaataagggaagagggaagagagaaaagagaagagaaggagatgaaaaaaacgtgcagctgacatgtgggtcccacgtactttttaaaaaaaaattgctaagtaggatgccacgtcagcaaaaccacctatatatactgcctagtgactttgactgaacggttttgtatagtttaggggtcgagatttctggttttgtggttaaggaatctcaaaaaatctcgctgttaagttgagggatctccagtgaacttattccaacatagtattcatgattcaattcggcggagaaagtccatttactcgccctcacttatagcccgaagcccgattctgattttcatccatgaacaacacaacagtaaaactacagatatcgaagcttccacaatataaatcgatgccaattgactcctttaatggtttgtgaaacaccaggaggtggtgtggtggtgattaaatttattttttaatcagttgttaccctgttctttattatgtgagactgttttttaacttttgttcggggttagctctcgtgctcctgcaagtgttagaagtcaccttgccatggcaatcagatgatcaaggagaaattttattttaaaaatgtgaaataaattaccaagtccttaaatttaaaccattatataacttagatatatgaaattataaattacatgtttgcgagtatattgttggtttaacgtatcacagcagatccattcctcgtttgactgtggatggctgccgatatggcactccacgttaatacaaagaatgtattcaagtgatgtaaaacttacactaaacctcttcttgctatagggttgaatcccctttcctcaacgcatgaattccccttgttcacggtgaaatgtactccatatgatgtactactacattaatctaaaaagatatgatagaggcgtctcgactggaaaagtttggaagaacatagcatcgattccaagcacgcaagctgcgaaacaacatgagcccaaaaaacccaattgtccattaatccatccatccattttcgttagaattcagccatgttgatcagggcaacaagaagacgaccgcccacctcaccatttccacgcgccgcccccacctttccagaaccttccctcgtcccaataccgtcgaatcctcgccgtcgatccccaatccgtgggcccaccacaaacccgcaggcgccgcatcttctctcttacccccgctccaagccaaaccccacctgaaccaaacccactgccatctgggccccacgcctcccggccccacatgccagcgacgcggagatgcgaatattccccccctctattctataaagaatacctccctcctccatcgccgcatcacatcgcaatccaaaccttcgtcttcgtcttcctctcgccgctgattcgattcgatccgatccgatccaaggtgagttccctcctccgatcgcgcgctcgatcttggatccgcgggtgcggaggattgctgtgtgcttcgcgggatctcgtttgacgctcgcggggccggatttggtgcaggggaggggaagcaatggcgacgaagaggagcgtggggacgctgggggaggcggatctgagggggaagaaggtgttcgtgcgggccgacctcaacgtgccgctcgacgacgcccagaagatcaccgacgacacccgcatccgcgcgtccgtgcccactgtcaagttcctcctcgagaagggcgccaaggtcatcctcgccagccatctggtcagtgagcaccccctgccatcgatccttgaccctcccgcgctttcgatctgcaaagtggcatgctactttagatttttttgggttctaggggtggatgatatttggtcgctagtactggaaggaattcggatcggaagctaccatttgtgtagatatgagtaactttgtcagggttgtagtgatcaacgtaggattcgatatgatcgaggcaaaggcggcccaatttttaaaatgaaaatcgatctcttatttgtttgtgttgtttaaatagatttgcattatgacagactgacataacggacttgacttaattaatgaactgttagacgaggtactccagatgtgctactgtttgttctttattgtgatcagtgcccgaaatgaactttgattgtgatgacttggaccagtgcattgtttaatgctcttgctgacctttgtgcttgccttccattttggttgggtaccatgactatctatttcttccattatattagtacgtttttaaattttggatgactaataagagttgtactagcataataatataatgaacattaaaagtattcagcatggaggtttgacctttagtgtaatggggtaattaatgggtttgatgatgattgtcttgtcttctgttgttttcagacaatgcaagttccttgtctataattgatcatcaaatttttgtataattgatcattaaatgtttgttaggtaggaaatagtggttaaacctgatcacagagacatgtcaagtttgtgcttctgcatttcacatgtatatttcatccagcacttatatctgtttcatttcactcacaagcacttatatctgttccatttctctcttgtgagtgttgtttcatggattggataacatgatggcatagtggtctgataaccaaaacttcacttttttgggctaaagttttgtgccatgagaacctccagtagaatatatcaatttcaggagtatccaaaccaaaacggttatgttgtatattgtacaacaagttgacaaataagcaactttgtgttgtagcttttatatgcagaagagtttataatgcttgtggtgcgtactgtgaacaaaacagaatggattactaatcaactgtaagctcttaactgttgcttttcattctaacatgattcacttttgtaacctccagggccgtccgaagggtgtcacccccaagtacagcttgaagcctcttgttccacgcttgtctgagctacttggagtcgatgtatgccattggatgatagctgttaacagttaatttttgttattgttgaactagacaacagctcttgtattcctctgatctatttgtgtgcataaataggttgtgatggccaatgattgcattggtgaggaagttgagaaattggctgctgctttgccggaaggtggtgttctactcctagagaatgttagattctacaaggaggaagaaaagaatgatcctgagtttgccaagaagcttgcagctgtcgctgacctctatgtaaatgatgcttttggcactgcacacagagctcatgcttcaactgagggagtgaccaaatttttgaagcctgctgttgctggcttcctgatgcagaaggtattgccaaaatgaagtctccatcctggtcaatgtttgcttaaatatatattcctagtaatacataggtcccgtggtaataactcataattaggaattgaattcatatacattattcacctcaatcctcaaccaacctagtttgtattcatttcaaagaagcaataccacccttaggattggcaaccacccaatagtccaccgaagagtttgttactttaggagtaggaaataacatggaatattagagagaagtttataagtaaattaatatttttttaatcttcaatgtattctccaaaatatgttgcataatgcttatttcagaataaaaaatacaactgtactgatatggttaattatttcaggaacttgactatcttgttggagctgttgcaaacccaaagaagccatttgcggccatcgttggtggatccaaggtctcaactaagattggggtgattgagtctctgttggcaaaggttgatgtcctcatccttggtggtggtatgatcttcacattctacaaagcccagggatatgctgttggaaaatctcttgtggaggaagacaaacttgagcttgcaacttcacttattgagaaggcgaaggcgaagggtgtttctctcttacttcctaccgatgttgtagtggctgacaagtttgccgcagatgctgaaagcaaggtttgttcatttacacagttctgcaaattacattttgctccttactaggaaactaaagtagttttaaatttaaaataacaggtggttgttgatgtatttcatttcaagcatcatacaagtaatgatcgattaatatattggcatttcagcctccatcatgatatcataaattcgaaaatgtttgtccctgtggatggcaacatccagtaatattcatggtgcatagtactaaattattacaaacttttatgtccgttgttttgatgtccactataccatcattttcagactgttgctgcctccgctatccccgatggttggatgggtcttgatgttggcccagatgccatcaagacttccagcgaagcattggacacctgcaacactatcatttggaacggacctatgggagtctttgagtttgagaagtttgcagcaggcactgatgttagtacaattgactcacatccgctgatctcctgcattttctttcttttttctgtcgctaaacattctcgtctttcatcaggcaattgccaagaagttggctgatcttactaccacaaagggcgccacgaccatcatcggtggtggtgactccgttgctgcggtcgagaaggctgggctggccgacaagatgagccacatctccaccggcggtggtgctagcttggagttgctggaaggcaagaccctcccaggtgttcttgcccttgatgaagcgtaagctaattcggcttgtctccatcagcagtctgcacttttgtttcagacctctcggtgtaactttgcaatgtcaatgcttgtatgaagaacttgagataggcttatcgtcaagttttgctagatgagtcgtgaataagcttttcgacttcctcgctgccgcgagtgaagtggttcgaactgacatacatactctcatggatcgatattttgatatgcggttatcacatccctatgatggcatcatctgttgatattgcccgatccgctgtggtttatctttgattttacgtatgattgtttgctgtgcgcatttatctgggttgtttttttacgcagaaatctgctaatctattactccctccgtttggattttgagtttttacttgcaacgttagaccacccgttttattcaaatttttttaaattgttatttattttatttgtgacttactttattatctacgttactttaagcacaacttaactttttgttttttatatttgcaaaacaaaattgaataagacgaatggtcaaacgtcgcaagcaaaaacttgaaagtccttatattgtgggacagagggagtacttgaaaacatgccaacatttttaacacaacaaatatattatcaaaatatatttaatgttacatctaatgaaactattaatctgatgttgtagatgatgttattttttttataaatttggttaaacctagggaggtttgactagataaaaaatcagaacgatttgtaatataaaacgaaaatggtatacattgttatgaaaccgatcttccgaaggagtcggatttgtaggaccgtgatcgtgaggatcacggtacctcctccttctattattctgtttccttattaatgaagtgggcttataccaaatatatatgtatatatccatataggatgttcttttgtttccttattaatgaagtgggcttatatcaaatatatatgttattaatgaagtgggcttataccaaatatatatgttatatgtatgtatctatataggacattctattgtgggtataaatacaatagtgaggttgagggcaaagtaatacttgtaacagatagagaaacatcaataaagttgattgccctccactttcgtgttcgtgtgtgcttgttcgattgttgacaacgtgaattctaatacgttatcagcacgaggtgctcttcagccaaggtatattgtcaacatcgatctgtcctaatctcgttctatagggataacgataaacttgctagatcgttttctgttatttttatttctccgctaatcgttcgatcgatgggttgtactacgtggatttgtcccttatggcgcatgtagcaggagagtttgcggctctccaccccatgcgcgacaggcgtatggggttatcccttgtacaaccgatctatcaaacgagaagcggttatcgctatagtccgattagatctgttcccagcctttgcgctgggtttcttttcttgcaaacaaatacacggataccgtacgccctagacgcgcgaatggatcagacaagccgccgcaagaatgacggtttagaactagtgatgcctcgaagggcgatgctacgttcagggtgtaatcgcgatgcacatgagaagaatcgcgtacctagctaacgtgattgccgattccgaacgaatcggcccaaatcctcatgccagcgccgccgtcctcctgaagttgacgacgacgaaaccgagtcgatgacgcccgcatgcaccgtcgtgccctcgccgccgccagcacgcgtcgccggccacccccttcaccaatggccgcagaatcgtgccatcggctttccgtcattggttcgcccttgaaaagccagccgacgggtcttcaatcgaccgcccgcacttgccgtaaacggccgccgcccgcagagacgctgaggagaccgcgcccgcatccccctgccgccggcacgcctcccgcgctaccgcacgcgactgggacgggggtcgaagccgccgtggcctcccgccgccgatagctgtccacctcgccggcccgcatgccgagccaaattccgccggcgcacagcaaggagctgcgcttgccggatgccggatatggcctgtaaccagccacgccggcgttggtgctacttgtagcctcaccgccgctccgcctctgtcgtcaaccccgccgcgccgatgagtcccatcaacctcgccgcctagcccgcatgagccgccaggatacccgccgccgccatcgaatcggtggaattgggggctagggtttcaaccctagccacccgattggataaggtgcggcgcccttgttgggccgcatatgggccaaggccattagcaggccgacggtcccgacgggccggttaacctttgaatagccggtacatagaggtaggccgagtataaattaggcctataaaaggagtcgggctcgaatcaaaatttggccccaaacaggcaaacttctgaatatgtccttgaattttcaggatacacgcggatttggaattttagcggaatagtccctcgggattatagaaattacagagaatatcacattttttgttattccgtactttcaattttctgtatattaactgtttattagttaatttttgaatcaaccatagaatcctaaagacatggtttttaggaaatgaactctcataatttgaaatttagtacacaccagagagcatcatatttatggtttattttcctagctgttttatttttttttcaggatactatttaatgggttagtaattcagtaattactttggtacctaaataaatagtacagcaattctgagaaatgttgggagaattatgggaatatattgacacagtactaaatttggataaccagacaatttactatttgcacacttgtcatgctcttacttgcagtacttattgaattttgcatgactaatgtagaaaaatgactgatattgctaagagagattttgctgaactagcagtcagcggcaagaattacctaacatgggcactggatgccaaaatcatgcttggtgctaagaaactcctgaactgcattcaggacccaactattgcaacatcagctggaggagttaataatttaccaacttcagccgagaaaaatcaggcactgcatttcctgaggcaccatttgaatactactctcaagaatgagtatatgactgaggaagatccgaaggtcctttgggactcactgaaggatcgctatggccatcaagtaaaggctttgctcccaaaagcaaaacgtgagtggcttcacttacgtttccaggattacaaatatatggagcaatataactcagttcttcaccgcattgtcacttttcttaagctatgtggagagaaaatcactgatgctgacatgatagacaaaactttgtccaccttccatgccaatcatgtgaatattcagaggcaataccgccaggctaaatacgagaagtattctgaactggtctccgtgctcatggaagtgcaaggagaagatgagacacttgttgaaaatcatacgtctcgccccaatgaaagttcagcaacacccgaagcaaatgctagctcctttaagaagggggaaaaccaaaataaccagaacaaagggaagaatttctggaaaaatggtggtaaagttaacaagatgtctttcaagaagaaaggaaatcacagtaagtctaagaaaggctctactagtggtgaatatggaaagcaagatcaggtatgcttcaagtgtggcactaggggacactggtctcgcatttgccgcacccctaagcatctcattgagctttatcaagagaagcacgggaagaagaagtcagagcatgagtcacacttcactgttgagatccagcactcagaggagaagatggctgccatgcatatcgacaagcatgtcgatgagaaggcagtggttgcaatgcacatcaatgataagatggaacaaaatgcagcagacgcagagctgaagctctcagatgatctcatggactctgatcagttatatggggacatttaagtcttccaatttatatcttagcttcctacattataagttactttaaattttagactatgtaatagactaaagttaggtgatttttcaagtgtgcatttagtttgtgttcctagcagaactatagtttctgtaagctccttcagagcaatggttatcttaataattgagtgaactcttttagtttaatatattttccagatttttatttttctatcttaaagtgttaattttttctatatggtcatgaattgattatatttaaatgctttatgatagaacagtgttacgtactatggcaatggaagaggagatgtgtctggtagactgttgtaccaccaatactatctttcgagataccacgtatttccagactttaaagagaaagactggtcaaatcgctactattgccggaagcaatgcacacatcgttggagtgggacgagcaacagtagttctcccacatggtaccaagatcattataaataatgctctgttatatccagagtccagtcgtactctactaagctttaaagatatccgtgctaatggttatcatgtagaaaccaaagatgagaataaactcgaatttcttctcataacgaaattagacggaaatcgtaagactgttgttgaaaaactcccttccttgaaatctggcctatactacactcatataaaacccgaaaatgttgcactgaaaacaatatttaaaaatcctgagtcatacagaatatggcatgacaggttaggacatccaggtctagggatgatgagaagaatcatctcaacttcaaatggccataatttacgaactaacgatttcccaaaccaagaagattttgtttgcactgattgtgcaacagggaaattaatcgttagaccctctaatctaaaggtgaacgcagaatcaccagtattcttgcaacgaatacagggagacatatgtggaccaattaatcccatgtccggatcattccggtattttatggtattaattgatgcatcaactcaatggagcactgttttcttactttctactagaaactacgcttttgcgcggcttattttccaaataatccagttcagagccagtttcccggataaccggatacaatccattagaatggacaatgccggggagtttacctctaaggtatttaatgaatattgcatggctttgggaattaaagtggaacattctgtaccacacgtccacactcagaatggtctcgccgaatcattaattaagaggattaagcttatcgctaggccattgctactgcatagcaacctaccaactacatgttggggacacgctgttttgcatgcagcggcgttacttcaaatcagacctactgcatacaatgctgtatcccctatgcagcttacacgtggatatgcaccaaatatttcccatctgcgcaaatttggatgcgctgtatacgcccctataccgccacctaagcgtacgtcaatgggtcctcatagaaaattgggaatctatgtaggatttgaatctccgtctatcattaaatttttagaaccattgacaggagacctacatatgggtcgatacgctgattgtatatttaaggaagatcatttcccggcattagggggaggaaagtacctacagaaggtcgaatgccgcgaaattgagtgggaaactaaaaatctcctacatttagatccacgtactaaggaatctgaccaggaagttcagaccataattgatttgcaaagaattgaaaataatctgccagaagccttcactaacccaaaggggatcatgaaatctcatatacctgttgtgaatgcaccggaaagagtagaaatacctcatgacgcagaggaaccggttttcaaattaatttctacatctaccccaacttctaggaagagggggagaccaccggttgcacacaaccaaactaaagtttctaggagacgtcctatgaaacaacagattggatagaataccacagcaccagagaatagtgaaggagctcaccaggtagatgagccacctgcagtgatatgcccggatggcaatgaacccagtgagaatgcgcgcgcaattactactagcactgggagaccggaaattcctgacttaaacattgcgggaaacaatgaagatcaggaatgtgaaagaatagaggaaatatccaccagttatgtggatacaggtgaaacatacaatagagagactactattgtcgacatatactttgccgaaaagatcgctaagatcattgatctggatccagaaccaaagtccatggcagaatgcaaaaagcgttcagactgggtcaaatggaaagaagcaataaaggcagagttaatctcgctcaataaaagaaaagtattcggtcctgttgatcgtacccccgtagggatatcccctgtaggatataaatgggtgttcgtccgaaaacgggatgagaacaaccaggtagttcggtataaagcgagattagtagcacaagggtttacgcagagacctggcatcgatttcgatgaaacctattcacctttaatggatggaattacattccggttcttaatatctatggcagtcaatttgaacttagaaatgcagttgatggatgtagtgaccgcatatttatatgggtcattggattctgaaatctatatgaaagttcccgatgggattcaagttcctgaagaaacaaaatgcaacatatacagtgttaaattgcaaacatcattgtatgggttaaaacaatccggtaggatgtggtacaaccggctcagtgaattcctagaaggaaaaggattcatcaagaatgatgactgtccctgtgtgtttatataaaaaaaaatcagaacatggattttgtattatttctgtatatgtggatgatctgaatatcatcgggaccacacaggtgattaaggaagctagttcttacctaaagacggagttcgagatgaaagaattaggtaagactaaatattgcttaggtctgcagcttgagcacactcatgaaggggtattgttacaccagtctgcatatatccagaagatattggagaaatttaatatgaaggattcatatccgacgagaacccccatggtagtaagatctctagcagtagagagtgacccatttagaccacaggaaaataacgacgaattattgggacctgaatgtccatatttaagcgccattggagctttaatgtatctcgcgaatggtaccaggcctgatattgcatttgctgttaacctacttgcaaggttcagttcggttcctaccaaacggcattggaatggcattaagcaaatcttccgttatttacgtggcacacaagatatcggtttattctttagaaaaaaaatcaagatttgaccatggcgggatatgctaatgctggatatttgtcagacccccataaagcattgtcacagactgggtatgtgtttctctgtggtggtacagccatctcatggaagtcgacgaagcagacgatggtcgcgacatcaacaaatcactcggagattatagcattatttgaagcgagcaaggaatgcatgtggttgaggagggtgatacaacatgtactgaatagatgtgggctgaatatcacaccaactccaaccattatttatgaagataattcagcttgtgttgcacaaatacaaacgggttatgtgaagacgagtctcacaaaacatatatcgcctaaattcttctatatgcatgaattgcaaaagaaagaagaaatcaaggtgactctcaccaagactagtgaaaatctcgcagatttatttactaagtctttgccaactagtgtttttgagaagcttgtgcatggcatcggtatgaggaggatgagagatttgcacaaatcagggggagcacttccctgactgtgttccgttgatattgatcatgcagatcattacatcattcttgaagaatgatagagttatccagtagattagcttatggttgtactctttttccctttagtgagttttctttgaagtttctcacatttaggtttttaatgagacaacagtgcaatataagtagcgtgtactatgtactctttctcctattcatttttctcccactggatttttggaaggagttttgatgaggcatatgtatagcgcggtattcgcccaagggggagtgttatgaaaccgatctcccgaaggagtcggatttgtaggaccgtgatcgtgaggatcacggtacctcctccttctattcttctgtttccttattaatgaagtgggcttatactaaatatatatgtatgtatccatataggacatcctattgtgggtataaatacaatagtgaggttgagggcaaagtaatacttgtaacagagagagaaacatcaataaagttgattgccctccactttcgtgtccgtgtgttcgtgtgtgcttgttcgattgttgacaacgtgaattctaatatgcatgatttaatttgttctgttattggatcaccgactgaacctatggtgattgatggttgtagttgttctgtgctgaattgcagtttgttatcgatcatagttgtataattttattcgagcaagcaatcaaaggtatgccaaggatttacaggaaggatccagcaatacaaagtttaacctatccggttaacctatatccagtactataacagaaggtgaagcctggtgcgccctgaatgaataagaaatggacaactgaggtcatgcttgcatgaaaaaacacctgaggttgataagaactgaagataataagttaaatgtcgattacacacctgaagttggtaagagctgagggacactgccccctcactgggcccatcatccaagcaactactacttggtgaagcctggagcttaactaaccattgttcattggtgattggtgatccaaactatcaaaatttagctgctctgctaactattcatctctgatatttctcttcaggaaccataatggagatcaagtttttttttgttgtgttttgtgaactcattttttagggaatgcacaaaagtccgagagaaaaaaaaaaggagaaatgagttgtgaactcattttttagggaatgcacaaaagtcggaggaaaaaaggagaaatgaaaaaaaaaaagcgagctgctcaatgtaaaatctcacaaaagtatctggaatgtgttgccttcaggttctgaattctgatggtatagttgaaatctttttccccaccatccgattgtctgcaaactttgactcttcattaacaaaggcgagtatctgccataaaaaaggcttcataacccgtgtaatatataaaaaatactttgactcttccacactagatttccaaatcgacataaagatttgtatgctagtaattttcatgctactcaaattccacttgcgaagggctttattctcatcgagcttgacctttatttttttagaaaaaaagcatcgagttttacttttcttttgatattattcttacataaattcctactccatggctcttttacttcgatatcattttttttgtctacttacttaccagcgaaagacatgtctttaagaaattttccttaccatatgtaccaccaaatcaagctttacagccctcttatatttttagtcaacgtgatgtttttatccattttcagcaatacaaatccctaaagttaattaatcagcatcaagttaatggaaactgtgttactttttcagccaactgcacagctttgctgaaaatattgctaccccaccacttaaacatgatctagatggccaaaatgagccacaagtaatttgtgaaaattaaaattaattgtcaagttgagctcataatgcaatattagtatcaatttaatgtgctaataatatggccaaaatgaaccagaagtaaattgtgattacaaaaatatcaagttgagctcataatgcaagagtcgacttccatggaacgtgcgtgcaattgtgactgaatagggagcctaaaggagtagcatgatgtatgtctctgtcaagcacaaacatcataatctaattttatggtttactagtgaatgcagtccatgagttgcatggccttttggaggcaaggaatataattgcacatgaacatattaggttaatctgtacctaattgtagttttgctcagcagcatgttctttccatgctactatttaccgacatctcatttcagggtgcttattttacttgtggaaatgacctgcctttttggatatatgtatcatttttgcaaatttttgtctgtgctatttgactatgaacattgattctgtgtcctcaggtatttcacaataattgcgtcgtctaagtattttgcatgctcagtagtccccaattggaattttccgcaagattttatcagcactgttaataatgtgcaggttttacttaatttacagtagatatagtactttgcaagtttattgccaattcaaaattatattttgttctttcaccatttaattggtagctttacattcttcatggtatgttaaatcatggattaactttcattgcattcaccacacacattttgttctttgaagaagctaacattttagacaaaagtaccacaattctacttctgaagtgagaaaaaaaatggtttaatatccaataaaaatattctattgcaaaagttaggaacttgaatttcgtaactgtagcaaagttggaagacatttagcagaattactgcacaaaatgatttcaagaggacaagaaataaacaacatttgaaactgtgtatgtgacaaatgatcactggttttccttcctttctatagttctattccactaaggatcagcttgatttaatgggttaagctgcttaagaaacagatatttccatgcaacttacacttcaaaaaaaaatgtttacatgcaactgaagcagatcaatacttctgtaaattatacatatgttatatgcagtgaaaaaggcgagagaattttgcatgaggcaaagcttttgcaaagtagaacaaaagcaaaatcacgcagttctatgaaaaggagaggacaaaatcaaactctcaaaagaaagagaaacaccataatgaaataaagatctaataaacaaacgaaatcgtacaacaaggtgagagatagcaaatctaccttgttttcatgatccatcataggacaacaaagaaatggagaacttgcacaatctccttcggatcttttgttggtggtgagagagtgaagctgcaacatgatctgatggagccaaattccaatcactcccacctcttactgaaactcacaagaacaatcataattctacctctactaaccaagcccacacctcctatcaccaatgctcatcaagaacccgtaattcccttcgcaagttgacacgacgaaaaacctcgaaaacgcggtaatttcagtaccaccaacaccatggatagatttggctcatgcctgacaaccagatcatgctggcagcttcattctctcacaccagcaaaacttcgttcttgcaagaacatgagacagacaagtaatacacacaggaaggagaaggagaggaatggagaagtggccattggcatgtactactactactgataatatagcagcagtgggcaaaggagaaggaagaagagagacaaaaacagtggcacgaggtgtgtgcaatatggttgtcacaagcatacatacatggtccctctcctacctctcacacctcgtgacactgcctttctttgccatcacaaccactgccccctactgcaaatctgcaatacatgtatgtatgtatctagtgcttggtgtgttcactgtcccagtactgcttatctgatttttttttcttcaagtgcaggtggtgatcaatcatgttgctgtttgccaatttttacctggagctggaaaaaggctgaagatgataccagtattatgtttattggtgcaaaatctttcaagtactgcagatgatcaatctgaattttaaggtggagatgaaaaccctgaaatgatagtattcttggtgcaattcttaggtcaatttttacaaggttatatgtgctgatgatcaagcaatggaagtagagtgttagacagactaaatgttcagaaaattgtcgatgcaaatcttgttttgcgtctgaatttgtccagggacagaatgacagatacattgatgaaactgaaagatagtacagcgtacatgtcgaggtatatggcgtttgcaggagcaattttgtgctgctctgaaacactgattttgcagcacaataaattggtaccaatctgcattctgacgtacactcgcctactccatagcgaacatctctgaattttccacgaagacctgttcttctttctgaagaacaccccctgaatccttctccatccttatcaatcgctcaatttaatttcttttcttagaacacgcaaaatatctgctgcataattgcattagttagaaatgttacttgatcagaaaacaaatttgcctaccattataaaagaaacataggaggtcaacaatggagcagtgaatttcccaaacaagctgtgcatgaattcaatcatcttgctttagtgggcaataatttcattggactagactaattgtctgacaatgatggcctaacaacctaacatgaagcttggaaataggacttgagagcgtcttaaatgctaatgatgatggtctaatcacatcctacaacttagagctagctgtccagcttaacacaaactgaccagtctttctgaggttcagtgttagagatgtttaaacatacatagttatgcacatgcataatcactgcctgaagaaaggcttcttcttctctctctctctctctctctctacaaaatgattgattattttctagccagagaaacaacttattaacagtttagctagttccatgatctgaattcttgatgcttccaaatgtaaagtaaatgacaatgttattctcaaaaaagtaaatgacaatgtttcactaatgaccatggatttgcagcatgtgaaatattcagaaaatgtgaggaatatgcagagagacagcaacaaatcatatcggcttaggatttactcgaagatgaatctagcctctgctcatgcctgtggctctgaatttgtctgaacctggcaagagatgacgacatctgcacgattacagatttacagttactgtcacgccctgcatacacatcggacaagagaattgaagccggcctggctggacaggaccatgcgaaattgtctgaatatgaatatatttgcagatgcggatgcagccagggtcaatgcttctttccaagacgcctgcttaatttctgtccgactgtacggccggaacttattattaaccatcatttctgaagattaaccactgcatttgcaagatttataattactcaatgaatcttcctttgagagatgcagttttgatcttaggttgttgtgcaaacgagcaataaatcagcttagttccagcaatcagttttgatcttagctaaaactgagtgggcagagatcaataaccaggaatcagctgcaaattaaggttgtatttgacaggaaagaaaatgagaaaattgagaagatatgtgaaatgagatgagctattagcatagggttaattaagtattaattattttaaattaaaaaatggattgatattttttaaagcaactttcctatagattttttaaaaaaacaaaaaaatataccatttagcaatttgggaagcgggcgtgaaaaacgagatatatcttctctctatctgctacccaaagcaagactataactaatgttacaaatttctatggatcagtggatgtggatcacacgctaaattcttgtgtgctacccacacacgtaataagttagtcagctgaacatttcaccgtcatagtgtcgttccttaagcatgacataaaggagtctcctttattcatatttaaagcatgacatatatcttctgacattttgaaggactttggcaccaaagagagcaatatgatcatatggaaaatgtgatatattttttatatatatagttgttattggttagggttcataggggtaaatatcaccgggagaatagccgggcggtgacgaccgctaggaatgaaaaagggacttaggatatgggagactaattctgattcgtcgcttaactagaatgacaatacaatccatccttatatagatgtagggaaggatccaatttaatcatttgtaacaaactctatccaactgagctaccataagatgagggaaccgttccctagggatactagggcctcaacctcttggaacactaactgacctctcgacccactacctatgatactacatcattccttttgagcagctcgagattacatccctcctttcaagcagctcgtcctcaagttgcagcacgacttggctgactcagacaactaccttagtaaaacctaacatgatgcaagccttttaaatcttggattcttttactattttgaaaggaaattaaaccaacgattatcatagatcgttgcattatgatattgtcttcagttgttagtcttcctcctggtagtaaataaataccatcgggagaataaccgggcgacatggctactagggatgagagagggacttagggttgggagagactaattttgattcattgcttaattagaatgatacaatatatccttatatagatggagggaaggacctattctaatcctatctaacatactctatcaagtgagctaccgtaagatgagggaaccgggacactagggcctcaacctcttggaacactaactgacctctcgacccgctaccatgacactacatcattccttttgagcagctcgagactacatccctcctttcgagtagctcgtccacaagttgctgcacgacttggctgactcagacaattacctgccggcctcctcactaaagaagagaagagagaacagagaaaagagaagagaagaggagaagaaaagaaaagaaaagaaatatgcgcagctgacatgtgggccccacatacttatttatttattttttgttgactaggatgtcacgtcagcgaaaccacccatatatactgttaaggggtacaagtttaggggtacatatttctagttttgtggttaagggaccttaaaaaatcttgttgttaagttgagggatctccggtgaacttattccttcctcttaacttttgttcctctacttgagctgagctgcaatgtacaagatgggccaagatttcctgatctgatgctgtgccactggacttggctgggtcgctctgtacaagatgggccaagatttcttgacattaaaaaagaagggactagctaggagctccaatgttaggaataagttcactttgtgaccctcaaatgtgatcgaaatctaatctgtgaccctaaactacaaaaccggatatctcgacccctcaactcttaaaaccggtgcaatttgactcccttagcggttttggtgctgacgtggcacctacgtggcgatgttgactcagtcttcggtccacatggagttaacgtggtgcctatgtgtactagaattaaaaaaatatgtgtgggaccatttgtcattcacacaaaatgtgggacccactgacatgtggggccatgggccctcttgccttcttcctcttcctccacccttctctctctttttctctctctctcatttctcttcgtcttcgtatgcaggcggtggtgggcccgagcggccgcggcggctagcgggaggggaggaggcgacccggcggcggctcggcggcagcagcggcgtgcggcggtaggaggcagcgtgtggcggcggtatgaatcggacgtgccacctttaccaacaagacccaaggaagggagtaggagggagttggagacggcgacgagaaggaggagcgcttgagccaccaagaactccatcccaatccctctccctctctcagctcctcacactctccctctcaccaccctcctgcgaaccaagtagtggcaaagcagagtagtagtagcagacactgtagtcacacttaaaagcgcaacagttgcagcagcagcagagcagcggattcaagttcgtggttgaggttgttggagtgtataaagtgaattgcccacctttccctatcagcttaggcttttaggtgcaactggctggtgcatgcaacttaatatggtatcagagccagaggtctcgagttcgaatcctggctggcgcgcaattaaataaaataattgcagcccactccaatattccacacttgagacttgagggggtctcgcgtgagggggagtgttgaagtgtataaagtgaattgtccacctttccctatcagcttaggcaggcttttaggtgcaactgactgactgactggtgcatgcaacttagaggtgactagacgctggaggagtttcttgcttgctgggtcaaagcaaaaagaagaaggctgggaatgccattaatgacggtaggattcttttgaggataagcggcggcgacctggcgtgcggcggcggtatgaatccgcccgacgagcgcaggtggagcgcgtcgtggtgaccgaggactaggagatcaagggcgtcgtactccgggatggcgcatcacccggtgatcggcgtctcctcctaccgccgcctcccctcccctcccgctcgccgccgcggccactcggaccctcgagcgcccgccgccgcctgcagacgaagaagaagagaaataggagagagaaagagagagagaagggataggaagggaggaggaagaggaagaaagaaagaggactacatatgggccccacatgtcaatagttatacattattattttggtgtgaatgacaaatgggtcccgcatatattttttcaatttagtatacataagcgccacgtcaactccacgtgtacccaagactgagtcaacatcaccacgtaggcgtcacgtcaacgaaaccactctccaaaaccaccgagagagtcaaattgcaccagttttaagagtttgggtcgagataaccggttttgtagtttagggtcacggattagatttcgatcgcttttgagggtcacaaagtgaacttattccccaatgttagtacaaggagaaggagcattctctcaaataaaagggataactttttttttctcgtatgagaactgcacatcattatatattaatattaagaagggaaagaggaaaactaatcagcattctccctcaaataaaaagggaaacttttttttttctcgaacgggcatcctgcgtagctgcacatcatcattatattaaaaaggaaaacttttgtgtttctttggcaaacccattttttatttttgcttgtttgagtccatgaaaaggaaaactaatcaacaggacgcatctacataaaaaagataacaaatcaatagactcacaaaatgttaaatgtgaaaccactaatctgtaacatactcatgctgttctaagatataattaattcatttcttctaaagtatcggtacaggaacaatgtttatcagtaatcctacagctgctacacctgaatctcgctgaacgataatgagttttgactgctcagtcaaatctaccaagaactgtgggactgtacagaccacgtacaaaatgacagcagatcttgctggcagcagttctagcagaaaaacatggcccctttcaaattatcctttataggaagaagactgccagtctctgaggctgcgctgctatcttcttcagaaggcaaggaggtgtggctcgttgaatcgccaatcgagcgtggtttaatgtaacatcgagctcgtgatgacagaagacgagcgtagtgcacaggggccactgcagagtgcaaaagaagaaaaaggtgtgaatatatatcgtaaccatatatgcttttgctagaggaaaagcacatttcctacagtaaatgatagtaggagaatgtgggggctcgtgcttaccaactgatatggattgggtgcaagttgcggagctgcaataataggtgacaactcgtccgttaaaccggtcaagggatttcaaaaatgtaaaaacacataacaagtggcattcttacgtgtagcagaggtagtttgtgagctcttggaaagaaccagccaagaagtcgttctcgtcccacagaacatgataatacctgggccgcttagttccctaatgggaaaattttgaatcagctaggagcgtgttacaaatgaaaaaaaaagaaaaagaattatttgggtaaagaagaactaagctcaacctgcgtgctgcggtggctacacaagtagaaatcaaactgatttggttggcaaatatttgaatcaaccacagtacctgaagttggacaaattcacaggggttaggaagaaggttttaggtttgacaagataggcagtacagcaaacaaaaattggcaactaaccagcccgtatgtttgcagttgaatcatgagtattcgcattatagtagtcagcaaacagacgtgtatggcgacacttctggagcaccacgtatgtaactaatggattataatcgggtcccatagatgcacacgcctgtttttatggcacaaatttatcatttcaaagaaatagaatgcagtgctcatcacaaaaatgttcagaaagaaaatgtgggataaaaacttcaccattttgatggcaccaagttcgtgcatcaaagcctgagggagctgtcctttgctcacaccatccctgaagagagcagtcgtggaataatgtcaaatatgtagacatagaagagatgagtccggccaggagtgttctctgtatgattctatcacctcggtgtaatcgtttgtgatcaataaagctcccttatctaaaaaatgaaaagaatgaaaagatgaggcaattcgccagacatagattaatacctgtaaaatataatccttccgggcttccgtttagtggctcgatagaaagacatgagatgctctctgcatataagacaaaacttatgtacatagactacaaagacctttcaagtatagtattcacatgctaaaaggtaacacaatcattcgtacttgatcattccgctagttgtggttcctctttccggatcatcctggactttaaaaagaccttgtattgactcctggtggcacgcttgcacactgattaaaccagcatacttggtaacctcgggccagtcttgagaagcaacaacctgcataaaacatgcaattgctacatatagcacacatatacacttaaaagttatagataagcaggactcctgcctccaggcaacggcgtcttaaatagtgagatgtgcacttacagcagcaatggaagaactattagcttttcctggatgtggatgggtgacatgagcaccaaatacaatagttggtgtatccctaacatgggggagtctcatttctaaagcatcaaccagtacagtatttcttccgcccatctacgtacacaaccaaaggaataaataaggacctgatgaatgaccagtcaagcaaatagtacagcacaacaaaccttagcattgattttaagggcaacgcttgcaagataccacttgttcatcttaagaacatgttttgcaagacaacattgagagatcagtccaatatctgtctcacatattcttttgacatcacctgtggatgacaagtacattaaataaaaaccattaattgatcagtcaatgctcacatgtattacataaagaaactgcccacatgtgttacaaagtaaaaggtataccataaagagatccattgttgttaggcaatattacaatcagcaggtcaagttttctgccctgtggtctaagtatgtccatgacatcgtcatgaagtgtcctgagtgcagattctacacatccaggtttagcaatcactagaggaagcacaggtttaactgaaaagacctacattgagacatagggaatatgaaaggtcaaaattgtgaataactgtgaggtaaaaaaaatggaatcaccttttgggtcatagagaacctaccatcccagattctcggcacataaagccaaggtcataacagaaattcctagcagcatactcccgtacactccagcaaaagttaacacatgcccagcttttcactctcccaccattgatcattttctacaacaaagcattaccataaaattaatttgcagctgtatgcaatattgccaaagatagaaacttctgtaaaatataatcacaacagttctgaaaaacaaataatttggaaggagaaatgcacaatatatgtcacctcagtaccttatgcatcatattccatatgccaagttgtggcaagaattctgtcgtctcgccactgtcatggaatttaagctgatagaaaaagaaaagtcagacctacagcataacacatgcaacagacatcgcaatcagcatatgtaaatgactgttaagacatacccaaggagcaggtaggatgcgagatttaattgatacaagtttttcctcaattttaatgccaaactctttagcatgtgggtcctcctggtatttgttctgatgcacagtctggtaaccaaagacataacatgataagaaaatctagagcataatatgttcttttccaaaagaacatgataactaattacatgtaaaactggaaactttaatccgcatatggtggcctactttaaataatctgttttcatattagaatcgcacctgttaagcaaatttgggttgttgatatgccatgtcaaatgcatgaaaatagtcaatggccatgataaagaaaactgaagcctgatgatagtagataataaaacttcaagatcacaaaacaaattacaagtggtgcgacaaacagcttattttcatatggacaagaaatatctgtgtgcacaatctcaaaaatctaacaataatgaaaaatgtcactacaacaaagaacacaacagaggtgcatcctaaggctcatacaagttggttcccttcaaagttcaaattaaattctgaggtaatgtgttagcctctgaacagtactttgaggtaaatgttcgtttacctcaatatcattctttaagccaagccggggggtatgcaaatttgaggcaaccggtttagccccaaatacttttgagtcaaaccaataccttttgccttcattcatgttagtataatttttatgttccatctaatataaaaggtctccacccataagacccatactcactctgaggcggagtggtagggttgcctccaaaaatatttttaaaaaaaatcagtgaaggaccactctcctcttcccaacacgtatacatgcacgtattcaagcatctgctatggtggctctaggagttaggttgtttgcgaaagggcttaggtgccacatttagatcagattatgccagtttatactcctaaatatgtatgatcttctagtgctcactgctcatgacatgttaatagcataacataaatcttgtgcataaggatgacagcatgatcaccttaagcacatcctcatgtaggtcttttgattatcatcgaaaaaaatccatgatatgacatgatatgatatttataactaacttgtggaagtttgcagattgaactgatccacttaatgttattgacatggctaaaatatttaaaagaaatcctaaacaaacataaactgaatgtagaaatttttgtatcaggttacctgcagaatgttgtagtcacgctcattagggggctgtcgagctacctgaagaagagcagccatatgttttgcattgagctgtttctggtgacattgtccctcagcaattttacagacctagaatacagaaggtgataagaagcagtttttataagacgatagtgtgtgtccattcttaatattgttggatattgtagaataaatgttcgctcaggatactaacctccaatggcagaaatattgtctccccaaaatgagccactttcaagcaaggcaaagatgggtactgaatactaaagttaactggaaaactgttgcaggaaaaaccaaaatagcattaacctattatcatcatagatggcctatttagagcagaactatagacacaagagaatatttttatgtgtgaaagcaagtgcatacagtaaataccttgctgcttgatggacaaggtcttgtacatgatatgtgttgaacaaaatgccattaatctgaaccttcagaccttctagagcctccttaatctaacaaagaggggaaaaaaagtgaatcttgtaatggagtgaacacaggaatttaaatcaagtactaagtaacagaatagcaatgatcagtttgtgattaaataggatgacaaaacgacctgaccttcaagaactcagtgctacataatggtctgtctaataagatgtcctcgttaagaagctgtgcaacatagtcaaccacaggtacaggcttgatgaacactgatgatgacacgtctgcaatagagtactaaacttcctcaagacatggaaaaagaccagaggcaagttcaagacgtacttatcccactatatgatgtatataggaatacagtgaacatgcattcttggcccttagcatgcataaaatgctagtgagcttattaaagtagaaataaaatattattcccaaaaaaaagtagaaataaattaggaaaccttaagatttctgcaatgtatcatacttcatattgcagcttcaagcatttacggaaatggtacaaacatgtaaccatattttatactgaacggtaattattgaggacatgtgttcctaatacacaacatatgaaacggtttcaatatgaacaatcttacggttttcttcattaccacttgtaccttattacttataagaagttcaactcaatcaaagcaagatcaatttcagaaggggcgacatagaaattctcattctcaggtctgaaatacaaaaccacgatgaatagttgggatctgaccgatattcagttgaagtcccatctgagtagcttgtattctttggtgaaaaccacgccagctttccaagaccttacacaattgtcggcattctcctaagttaggtgagtaaaatgaaccagcaaattgggtatacctgaatatgcaaaattattgaatgggaataataataatacagaaagacggaaaacggaacacagtgagaacgaaagctaaccttgcagtgggtaattcctttagaacaacgtcaagtgctcgcagggccgctcgactttctcggtttggcttcccaccacggaacttgcgtaaagtccataaggaaatttttgcagcaaattttaaagtgaccacaaaatctctcactctcaagtgccttgactcttcaggactgtcttcaatactatccagcagaacaagaaatctatgtgaatcaaatggcaatggaccagatgtgtatagcctcttccttccatcataggcaggaagacggccacccaaaccagaatctttctgctgttttaccaactctctaataacagcacgattgattccaacctcaggagtgacacatacctgataaaaataacatcagatacgaatactaatggcgcaaataaatttcatgttatagacaagttatgtgaatcagaaacttacatcatattcatagatagtctgatcatccaaagactccagatgaacactgaaacaatttgtcctcacaatgcaactttcgccaatcataccttctgaagagagatttggacgttttgctaatctataagttgatagaatggcttgtctttcagctttattatgtttcaaggagtggtgacgatcgtagagccaggtcattctctgactctccatgactaatgttccaaggcaaggtacaaactttagcactgtaagcggtaagaatagcaatgatcagagactgaagcatcaagacacatcgacagttgaaaactagagtggcatcatcaattttcacgaacagcacagcattgcagtgacctccacacttgtattcacaacagcacagggaaaagcaaaaggtacgatacgccgttgttttcaggtaaatgaatgaaggaagataaaagggattgcccgaccagaccaatatatgcactcgaacattgggggaaaaattctatctaaagagaggcaaacacgaaatcgatccccccagagctaagatgaaggaagaaaaacagtaaaggcaaattgttattagtattaaggttagggcaaatttacagaacagaggctagggtttaacgcaaattcgagtagaagtgcgtgggtagagagagagatcggaaagagcgtgtataacggatgggtgctcaccaggatggatgcggcggaagcagcaggacgaacgacggcgcccctgctcgctcgcgagatggataggaatcggcggcggcgggcgaacacacgagcagtcggagtcgacgcacagcggacggggaaatattcgagcaacgatgatttcgtaatctaatcggtacgcactggtatatttatttaagcaccccagtaagtcacatgaaaccatacttcctcccacccagaatataatcacttttaaacttgtatactgttactccctccgtcccataacataagagatttctgtagatatgacacatcctaatacaatgaatctgaacagaccgtctgtccaccaaaaatcgcttatattatgagatagagaaaatattaaaaaataggtataattaaataaagagagctgtgattagataagaagtggagatatgtggaaaaactgaatagtgaagagttgtgattagctgagaagataatgtctgttataaattatcaaacatttgaacatctgcatgaagtattaaatataggctaaaaaataactaattgcacatattgcgactaatttatgagacgaatcttataagcctaattgctccataatttaataatgtggtgctacagtaaacatttgctaataaaggattaaattcatgacaccccttaatgtcattctgtagaaatggggggatgagatttctcaaaggaaaatataacatgagaccccacgtttatttttctctgtaaggccatccccaaccctccatatcatctattgtccatagcatttaatacattgccacgtaaacaaaactatgatgtggcaagagagttaatgatgagagatgtaaaaaaatgaagaaaccatttctcatgcaagaaatggataggtggatgaaaagagagagaatagagatgattggatgagaatttaatttgaagacaccatccattggatagatagtttctatacatagtatctatattacatgacaagtatggaaactactgtatagtttctggcttggggatggtctaattgggtagtagagagcaagtccataggttttttctcaaatatattcttttttttccaaaggagctaatagggaagcatttctaaagattagaatcatttagattttacttgaaaatagttcagtccaaagaagccctaaaatagagaagagggccggtatgatttgtataacatgagcccaaatgaaaatgattgtaagcatataagataagattattgttatctaggattccttcattccaatttcgaaacactcactcgtctatatttcctgtattatttatcaattctttattttatacgtgtaattttatgtttcttcgtatgtttctcttctcatattttgggcccctttgaatcgcagggttaaaaaaacagaggaataggaaaaatacaagattctgataggaattgaagtgtaaaacagatgattgcaaaacacaggaaaaacacaggaatggtcgtttgatgggaacgcatgaaaaacacaggaatcgaatgagagatagactcaaaggaaattttccaagaggttggagttcttgttatatttcctccaaaatccacatgcaatgtgccattccataggaatttcatgggatttggaaagcttcagagccctttgatttataggataagtgtaggaaatttgaaggatttcaatcatatggaaaaaaaaatcctatgaaagcctttgaaacaaaggattgaatcctatactatcctttaaaattcctatagaatggctaatcctatagagattttggaggaaagttagcaagaggtccaacctcttggaaaaattcctttaagtctatctctctcattcgattcctgtgtttttcctgtggtccaatcaaacggtcatttctatgttttaactgtgttttccaatcctctgttttacacatatattcctgtcagaatcctacgtttttcctattcctccgtttttccattcctgcgatttaaagggaccctcaatcctttgaatcaaatggccaaatagaaattttttctatatgatttgaatactatataaatcctttgatttaaagtcactttgtttttcttctgatcaaacagggtctgatggaactactgatggaacatccctggatccctgaccatactactcccgtccgtgaatctctcctcctctttttattgcagggatccatgaacttcaacccctgcagttaatgcaaaagctttgcagctttctctcggtcattgtgggagtagaaatggatggtactgctgagtcaaaagttagaaatgcttatactagtcccattctccgaaatataaacgactagtctgttcataaattaaatataagttttctatagtaccaattttccaatccaactcctacatctgccccgttttatagctacttttacccattgttagtattaaaggtaaggtaaaaaaatatttgctactgtattgtataagtagtagttaagatgatcagtaagtaggtgaagaaataaaatgagatatttgttatgacaggtatgtagagaagtgtatatatttaagacaacatttgaaatgctacaagttgatatactaggttgtacctgtattatttcatgtatttgttgcttcattttaattatggtcaagaaaactaatgagctgtcaaatctcaaatgtataaaggtagtctcaccgtaaccttaacctcttaacttaatctctgctaaaacttcactggatattttgccttgagaagtgttcttcattttgtggaacctcgaggaatgcccatccaactatagaaaactactgtatgatttgttgtgaataaatagctattcgagggtacaactgaattatttaaatattataaagtttgaaataaatttaacaaagtttcctaataaatttatttttatatagagagagtaatgtttttttatgaaaataacactgtttatggggcttagaaaacatgcgcattcatccacggatctactccctccatcctaaaaaacgaatctaaaactatatgtgatatattttaggactacgaatctccaaattcgtaaaatgtgttgggttggttttttataggactaaacaccctaaatccgagccgcgcatggcatggcacattggcatgcacgcgcccttccgcgctgcaccgcaccgatcaaacttttcacacgatcgaactctccacacgacgcgactgcgctagctaggaaaaagctgcaactctgccatcccaactgcccccgggaagaggggtgagagaccaatagatcaaaggatgatgcatgttttaattgactactatttgcctcgactaccattctgagggggagtacgcggaaagaacttgttgtttcctgctcaattaattaaaacaagacacgatattgaactctatatattaatattaacttgaaaaataaaagaaactaaagcagatagtgactaggaaaattgtccacaaaaagtaaacaatgaaagatagtgactactccctccgtttcacaatgtaagtcattctagcattttctacattcatattaatgttaatattgatgttaatgaatctatgacatatatatctatctggattcattaacatcaatatgaatatggaaaatgctagaatgacttatattgtgaaacagaggaagtaggaaaattgtccacaagaagtaaatagtgaaatactcctacgaagtaatacagtgaaaaaaaaacagttcattacttgcaaggatgcttgtagaggagacgtcaaacaaatggcgtagaaaaatgtatatatgttcataaacccttttttttacagtgattttttttccaatctccacctccttttaattttctgaagtcttttcttttaattaagcaggaaagtagcttttccttcaatgtatcttctcttgtttagtgttagtggaggtgggtcccatgggcaatggaaacatcattgatccattaatggatggttcagattgaaggtaaggcaaattttgccgttgggacttgggagcaaaggcataggatgcggatcctcatcgccggtgtggatgtgtgtaggtgtgggcgtgtggctcaggttactattttgtctatggccctgtttattctaactttttttttcttcgaactttaaatttttccatcacatcgaatttttctatacatataaattttttctattacatcgtttcaattttttcaaactttcaattttagcgtgtaactaaacacaggctatgaatctaagcttcgtttgaaataacttgcatgcagacgcaatgtaccgtgtgtacaccaacgaattaccagttttttataggacaaatgcatgaattttttttatgtttaataaagaaatggtatcagtgctaatcaaggttttaaaacacaagtactgtacctggtaagaccggttttaactggacacatgtttggacttgaaattttcagttcaaaaaatgttactcgtggagcttttttttttttcaattttctccaaaacttggtaagactaaatggaattgtttagagatcaaacatatgtgagggtgcgttctaaagagcttatccggttaactactctctcatttctgaactgctaaacaatatttttttcatatattttctaatagaagtttatttataaaatcaaacaaattcatttttttaatttataatatttcatactcaatttaccatgagcgaaacatatgttgtattttccgcgccactaaatctacacattcgaatccaaccttattgttgagcaaattccttatgtacttgcatttttgtttattttttttatcaaaacacagtgagggaggcctccatggtatatattaataagaaaaagggtatatacaaggacggcctaagccaaaagagaaaaaaagaaaaaagtggcacagaaatatatattaataagaaaaaaagaattttcatttatttctttctatgccttaatttttttttgctttattctctacatgccatcgagttttcattttgatttttttctatactcattctgttaattgaccacaagtcgattgttagattttttttaaaaaagtgactatatccctcaacgtgaaaaaatgatttatgtgaggaaaaaacaaaggggggcataattatttgaccataaatttaaaatttgaaaattttaagtatattttaaaccaaactggacaaaatccgtacaacatcttcaccatcatttttaaaactattaaaaaaacaacatgacaaaatggatacaatttcaaaatcgagtccttgtgactgcgaggggagcagagtggcaacgggggccaagcgcggtatgctggtctgtacttgggtttcccactttcccttgttagcaaaaaaacaagcaagaaaaaggctgttcgcttcatccgcgccatgtgtctcgttaccaagaagaagagagagagagagaagtctcctgcaagccttggggtggtggagggtggtgtggtcggtgtttggggttttgggttctctcctcctcctcctcttcctcctcctctctcggcctctccccatcccagatttgcaaaccagttggagtagtcgtcgtctacctagggtggcaggacaggaggagcaagaaaatgatagggatgggggagggagtagcgatggaagctaagaatcaaggcaaggaggaggaggagaagcaatatcgaaaggaaagggtgtgcggccccgatcgatcctccttcccacccccacctagctctcgcgcgtcgtcgtctcctcgaccgccggcgcccgtcgcgcgcgttcgatgatcgatcctgagccgttgcggttgcggttgcggttgcgcgtgcgtgcgtgcgtactgcgtgttggtctcgcctcgccggccggcacgtgcgtcgcccggcgaggaggctccatctttcgtcgccgtggagaccacgccgcggcggcgcgcgcgtacgtctctttctccacgtttctttctgtgtagtcttgtactaaccaagaaatgatgcatccaggacgtactatggacacgaatcgagctccgggaccgggaggaggagaaaaataccggccgccaggagcacgcgccgctcaatctcacagctcgggaggaggagaagagaaataccggccgccaggagcgcgcgccgcccaagggcacatcttctcgggaggaggaagaggtgaacgccggccgccaggagcactcggcggcgactggcactcatcgggaggaggaggaggcaaataccggccgccaggagcacgcggcggcggcgactacgggcaccaaccacaaccagaaccaggattgcatccaccggaaagaggggggagcacctacttccgaaggccaggagtatcaggaggaggagattggagaagcaaaccggaaggacagacaacaacaaggacatggtacagcctcttccatctttgagtgcaatcttgctcttgaatcttgaagcatgcacgtactcactcgtccgggacgtcaaggatgcagctttgtttcttcgtcttaacgttggccacctctttgtttgtatatgcagggatgggttctcgcggcgacgggacgaggaaatggattggcggcacagtcacagaggagaagggattgccaatcctactgaatctcctaccgccgacatgcctccaggttcatatgcattcctcatactctgtcgtgcatcaatgttcacatgcggatccatcggtctgacccgcgcaaactctctcccataaaaaaccaacctagtaacacattactttttccgtccttgaaaaaccaacataatattggatgtccaaattcatagtaatactataatttgtcatatccgacactagattggttttttatggaacgagggagtatgcgccgcaaccgtaagccgctcagcccccgcgcagcctagtgcttagcgttttaatttaacttttatagtaaaacgataaataaattattaatttggaattttgaaaatgagttgaatgttctaagttggagttgaaagtttgaaattttgaattgaaaggacttagttgcaaaagtatattgatgttatatatattagagaaatgctacagaactgtacacctgcttcaaatgccaagattggattgttcttaattgttatgattgtgtgtgttaaatgactggtgctgccttgaacaactataaacaaaagttggctgttgtactctgtgtgtaatagtaattcaattttcttattgccatttggttatcaacaacaaatgcaccctttttctgttgttggttggttaataatctagatctacattttacttatgcagtttcctatgcaacaaattaaaatctgataattttgtcacaatatatgttgttgtataatgcagttgatcttggcctactaggggaaaccaaaaaaaatactgttcactgctgttatcatttttctttggtagccagaactttgatgatgttgttaggctgcgttcgtttgtattagatagggtgagaaagcacctcgttttccgtgcgcacgcttcccaaactactaaacggtgcgttttttacaaaaattttctataggaaagttgctttaaaaaatcatattgatccatttttgaaatttaaaatagttaatacttaattaatcatgcgctaatggctcacctcgttttgcgtatctccccaatctcctactcctcaaacacattagttgtctagaagtgagatgggatgaccgccattagcctgataacagtttgctcatctagcttattttctttttttttcctgtgttgttgccagtggcagagcataatggaggtcaaactgcgcagtggcccctccagtgttttcaagttgatgtagatagtaatatgtgcaacactgcaacatcctagatttgataggtaggttagctggcggatgtctcatccctgagaattaggggtttgattctacttattctttttttttccttttaggacgtacatagattatttattttattttcacgctactaatattttcttgtcgacattatactatattttacactttttactaaaacgtttacatttttaaatacctgtcctatagtaagagaaactttgttttaacttttgatattttgaacactctttacatgcttatataatgtttcccctcttaagtttatgtcaagctccaccacggttgttgctattgatgttgtttgtcggagaagtgggaacaagggttttcactttatcatatgcttgggtcactatgagccccactttgtctcaaggggaagatggcgcacggcatcaacctttgccccaagctcacgaagatgacctgaggaagacaacagcccgtggacaagtccttcagaccccggggctgaaacgtctaacctgggtggattagggccccgagcccccgaggatagcagcaggactcgaggtctccccgaaggaatctggcccattaagaggatttgactaggtcttgtgcgttattttatcctatcattttgcattaattacggggtgatacaaatcttgtgagcttatcataggcgacataggagatgtggttgtgcatgctgcctctcacgcgcccacgtcaccttggagaaaaaggtttgcgatgtgccacgccctcaactatcaccccaagccctccctgtcagcttcggtggttgataggtgggcctagggacaaataagatgaagactttgcggccttgctccagatgttagctagtaggtgagcccattccatccgaccggcctacttggagggacagcgacaagaccaagcaaaccaacccttgtgtattgggtccctctttcatatgcatgcatgggcattgtggataggcctgctaataggttgggtgggaattggtataatggattggttttcattttgggtagaaatggtctaacgaagctgttgggttggggcagtttggactttgctgaaagtggattggatcgatctggttttcggtcatatacctttgggtccaaaatgggttcaacccatggattttcattgaatcgtccccaaatcctctatgctagcttgatggacacactcatcttcctcgtgagcacaaggatgcccaaggcatgcccgtcggcatgcgtcgtcgtcgattcgggcttggacgccatgcgcgttaacttcaagcacctttcaaccatgaggtagttcgaggacctcgcggcgaaaatcttagggagaaaggagatggtgcgttcgtaggagatcttcgttggcgacaagtacaagcagcaatagtccgccgccacactcgctttcctcatggatgcaactaggtcgactatgacgaacatccgagaaaggagagcatcgactatgacgacatccgagaagtagcctcgagcggccagaaatcatctatttgctgggaatcaggcgccggcaaggacaactcctcgaagatctaccacttggtgcgtcatccacaagacgaccaatcactcttttacggactgcaaggtggtgcaacacgtgagagctgaactcgaagcctgcaaggaacggggtattcagcgtgcttcaccaaccaagaccacctggtgtctgatccataagtcaagactcaagaggacatgagctcttaggctgcaaagtcttccttgacgccaccaaacctccacgccctcagatccaagaacgacgagttcaaactcgaagcgttgcataggaacagagcccagggagctcctgaccgtttcgggattcattggtatggacccccacgaggcctcggttttacatagcttggaggatctagagtcctcggcacctaatactctacgaaaggtgaacgtaatcgagggagtagtccgagtaatcaaaatccaactgctcgggcgaccacagatcccatctgtactcccgccaagcatttgaacacaatcaactcaatattaagatagagcccttttgatccggtcatgttccctgatggcgggtcgaacgactacgatccacaatggtgaatctcaatagtgcttttgcggcggcgactggacctccggctcaagatcctcctcaactcccagctcgaggagaagaggtgcacgtcgacggcagtgtcgaagaagaccccaacgaacattcgagctgagatcctggtcgtaacctcccaatacctcacctcgaggacctcgtcaggggaccccacccctcaagataatcgcgatttacgtgaccacttgaacgggcgccgacgggaacgacgagaacaagacaacgctcaccgacatcagcgccgttcacctcgacgcaataatgacgacaaccgagcgttcactccaacattgcgagaaatacggtggatcgaaaaattctaaccaggagcgatggaagcaccgtccctgaggaattcctccatgtttattccacggttctttacgctgctggagcagatgacaatgcgctcgcaaactacttgtcgtctgtgttgaaaggatctgctcgatcatggctagttcatctcctaccctgctcgatctcagttcgtcgccaactttcagggtacatacaagtgccacgcgatcgaggaagaccttcacaatttaactcaacccaggtgaatgtttgagggactatattcggcggttcaatgaatatagaaatctgtctcaaaggaatctgccccattaaggggatttgactaggtcatgcgcattactttaccccaccatttcacattaattgcggggtgatatgaatattgatagcagaccacatacaatgtgagaaacgtggccatgcatgctacctctcacacgcccacgtcttcctggagaaaaaggtgtgcgacgtggcacgccctcaactatcaccccactaccccctccccctttgttagctttggtggctaataggtaggctgatggacaactaagatgaagacttttgcagccctgctccacatgtcagccgtttggtaagcccgtcccatctgaccagcctacttggagggacagtgacaagactaagcataacaacccctatgtactgggtcccacttccgcatgcatgcatggggaggatccatgtctctgagaaaaaaaaaagttcgactccctggagtagactaagttcatacactcccacttagcacattccccctacacctgttgtaaatcttgttcatcatcacatagagtaagaacataagagtagggtattacgcttctcagcccgaacctatataaaccacctgtcccaccttctttctcttgcatcctggccacaagcttagaacctgcaccttggccgaactctgaagggaaggtatcttgcattcccactagaggagctccgtgctccgacacgttgtctagaagagggatgagatagcgccattagcctgataacagtttgctcattgagcttttttcattttttcccctgtgttgttgctatttgtaaagagatcttttacagtgtttgcgaggtacttggaggtggaacaacgtgaaccattgataagagaggggcaaggtacggaacaaaaatattgtaacatgatggcagtggagtaattaacttgtaaaacatgggcattatacgttaattgaatactaacatccatctgtcagtattcagatcggtaagtcagtatccagatcggtaagccatcagagaaaagagtaaatcacggatatcaatccgattgatccgtaacagatcgcatctccattcttctttcccttgggttcgttcttgttctagggtttggatgtttcactggaaggagacaggttcgccaaaaggagacagagagaaaagttttggcatggttgagggttgaagaggagactagatcgcctggtcaacgtcaacctaacgcatcggtaaattatcctatgcttatttacagagttgattaattatttatgtatagttcataagttccttatataagggatttagaatttttgtcaatttgtggtatattaaacgagatcttctccaatggtgttcttctagtgttttaacgggtgtacccacgaggagacacggttgaggaagaagctctggtatggttgagcgtttgaacaggaggcaagatctaattgacatgtacaggtgtgtgtataagtaagatatcctatgcttatttacgtagttgattagttatttatgtagctcacaaatttcttcgtacaagggatcaaaaagagatatcctaatatgttcttcatattagggtttgaataggtgaacttgcttggtgacataattgagggagaagcattggcactgtcttgtgtttgaatatgagacataatctgattgacacgtacgtaacaagtgcataggtaagatctcctatgcttatttacgcaattgttatagtttttaccgagttcatggatccctaagtttacttgggtagggcctgaattgacacatattgaattttcttatttacatagtttagttcttgttaatgcagtgcactattctttcgtatgtaccgcatgcaaattagttgtacactaaattagcttttgtagatttgtttatacaaagcaatttgctatgtacaatttgagttaaaattataaattaactcaagatggtaaagggtgttctaaaaattaaatgttgtttcttgtaggttttaagctctgatggaggatacagggatatcggttgaggaattgttggagtaccaacaaattgtcagcaagacattcaatagtgaggatgaaggaattcacttctacaacaagtacgcttgggataaaggctttagcataagaaaatcatatgctgaaagaagaaatgccgcaaaagaggtcaaacggaaaagaacctatgaccttttgttgtaaaaaggctgttgttgatgaagtttgtctgacatatttatctagcgggtatgatattggtgtttgtgagcatgctcaccatgagtcagactacttgtgttgatatgttgttggttaacttgacatagcatgttcaattggaggcaagtatcataaattgatgaaatgtataatttaaattgatgctaaccttgggtgatattttaactggtcatgtttctgaaacacaatataaatatcttgctagaaacaaactataatttttaacagaattaaggtatgagttgtcatgtgttcgttggaacaaaatgtaaatgtagaaaaaattcacataattaggctacaaacgtattataacaatacaatgtaaatctagagaaatctacgcaaaagagaacatcaaagaacactacggtgacttaactcgaatacaacgtaaatcttcaagaaaccacgtaaaagatacgctgataccgtgtagagcgtacctatgcggtacctattataatttggaggacaattctacccttttcactctactagcaaaattatatttttaccattagtacctaaatacctatattaatacttaaatacctttaacatggtacctgtgattgaggagcgttggatctttaccctttttgaaatgcaaacaccgtaaaagttctcatttgtaaaaacttatagtttttgttaatagaaacagggggaggtcatccctcttttctcttaagaaaatgttgatcagggtagaggtagggtagaaggaccagatgccctacatgttctctaagtatctcttgtaattttccaatgagtaacgctaataaatcttgcttcgtgacacttgtctgtgaactattttatgattttattagacaagttaacccatatatctaaaacattgggtttgccctgcagttgatccagagaagccatggcatgtccaaatgctggagaaggaattcattgagtggaacgtgccacaacacttacgttccaccaatgatcttgtcgttggaggagttctaatagcatacacaatagataaagaagatgacaaatctgaagagggtggatctgcaaacctcattaatggcaagatgtccttcctggtagaagataaaccacatgacattctttgctcttttctgctcgtagacagtctggctactgcagaaagttatcaaagttgctcactaaaagttaaccacaaaagagttgccaaagcatatttcataggctataacagaagcttatgcaagtattttgtctgttatgagcggctgaaccgcttctcctttaaagaggatagaatagatcaccaacaatctagcagtgaaaaaaaacaacagccaaaacaacgctggaggaaaaatatcaggtaatgtcttacccatagattacatatgatagatctagctcaggtaaaaaaatttaacatacaatctattttgtagtgaaatatttgaagccttggaagcacttcatgtggcgggatatggaaataactatatgaattcaaccatcacttttgcttatggtcagggtaatgatcaggacaagctactgaagatagtcggtggatgtcccttgccatgtgatgatactagaaccaaaaagtctcagcgagtgaaattttgcacattccttcgaaaaatcggggcagaaaatacacttggctatcaagcatttaaggtgaccgtacaatacgggttagtaactaattactccaaatttcatttttgttaaaaaaaattaatgcaagggctaaagaaaccacttatatacattcctaacaagtttaacaattaaaattattagctctaatcactactcaggataaaagagtagaaggtgtatgcactagagtatttattatcatatattacaaaatcaaagacctttttttataggagtatggctgtgtttagttcctcctccaaattttttttgacgtatacaggcgtacatttgaagtattaaacgtagactaataacaaaataaattacagattcgacctataaaccgcgagatgaatttattaagcctaattaattctttttagcaaatgtttactgcagcaccacattgtcaaatcatggcgtaattagactaaaaagattcgtctcgcaatttacatgcaaactgtgcaattggtttttctctcgtccatatttaatgctccatgtttatatccaaacatttgatgtgatggaatttgtagaagtttgaagggaactaaacacagcctatatgttcttttatcgggctagccactgacctgctacaataacacgtttttacatctcctgttacaaatcatctaatagctcaaaactagctaagcagttcacgtagcatgcatgcacttcactttagtaaatccaacttgactactttctcaagaaaacaactaagtttttcatatatcttgcaccttttcgatcgtttcaaaaccatccatgtcttcgctttgttggcagtgatgacgtcgaggtaatcatgaaacatccatatatcttggcctcggataaagaaagagtcgctgctattgagcccatgaatgagagattgtatgaccttgctgagagcaaacgtgtcgatctaaacacttctctcaagcaaaactttcgagactgggtgtggcagtcgatggtaaagaaaagcaccaaattttctgttttcctctgctcaaaccagattaattgggacgattatgatgacagcctggtcagcttggtgagatttctcagaaattttgttgagcatcagcgtgacatcgccataggacggcatcgctttatgtatgctggttcgagccagactcgagacagagtcactcgattgtctctctcaccactattttctttcacatcttcttccctgttagagcaaacaacatgtaagatgtttgtttatcactggcccaacctgtaagatgttttgtcacttcatttatgctacgaaccttgttattttctgttttaactaaaatacatctttccaatcaaaatgccatgtcataattatcatcctccaatgaccgtgtacgtgtacgtccggtttggatataatccggttattggaggacgataataatggcattgtcatttagagaatcttttaaataaaaacaagggtcatgaataaaatcggttttttaaataaaaagaaaaaaaaataaattaaaaaccagacttcattcattacccttgtttttatttaaaagattctttcatttagtagtcgctcactgtgagacacctttcatcatacttgtctgtttattccgctcaagactttattcagtagaatataccgttttggagaaaatttgcagaaatatgtgtaggaatagaataatatacttggtattttggtaggtggcaaaatcccaagttgcataaacaagttaattgatactccatgcattttactctctattttttgtacgggacgaaaaaaacatatggcaatcatatagtctcgttcaggaagcaaacatacaagcccagttcaacaactccttgagagcttcatgggatgctaatatttcctcctaagccaaaacgatttattaggagataaaatttttatgtatttgtttgtaacaacttaaaagccaatgtaaaaagagattatgttaaaagtattataaaatcaaccttaaaaatcaagcttgaaaatttaaattttggttttcaagagtcggtttcgtactggcttggctgggtcgggctcgggctgggccatgaaaagcagacgtcgccctccaactcctcctcatcgtaaccatcctcagtaaaagtagggcatcgatcagccgcgcccaccccaatctcgctgccgcctccaccgatcgccggcggcggccacccacacccaccgtcacccccaaccccaggcactctcgctccaccggtcaccgggggcggaatttgctcgtttgtttgtccgatccgatggatctcttcatggagctgaaggagcgccatgattacgtccctccagaagatttcatcacccgagtgttgccgcccgaggctttcgccgacagccgtgacatcccggagtatgaggtcgcgttcatcagagtgcccctgtacgagctccgtgaccccgtcgacaagggcctcatgaggaagcgcattgaggagcagcggcggcgggaggcggagagacggcggcagcttgagaaggatatgcggcggtgggaggaggaggaggaggaggaggaggcatggccgtgggaggacgacgacgacgacttcctgaggatgtcacaacagctgtcagtaatctgttcagaaagccgtgggaagagaggggattggcctaatatgaaggcaacaagaagagggagaagaagaacacatgcattaaccccagacaatgaggaggaggaggagaatttgagtgagctggagctagccgtggagaacacacggcgcaggatacatcactgcaactgcaaccacatcccgcgtcacaccctcttcacgagccacgccgatgtggaggagctcttcctccctttcaagctggaagagccttacctctgctttgcctcgcgatgccagaagtctgcgccctcctacgctcacttcttccccgacttcaaccgttcaccggtaattcaataacttccctcccaacaatttttactcttgctgcctgacattgtgcataaatatttgactagcatgttattgacacttgcaagcattgtttatatctctatttaaatcttctggcttgatttcgtgctcgcggcattgcaacatatctcaaataattaaatcataggttctgagtttagaaaagagaaaattccaatatatattgctgtatcatctacagctagtagttgcacatacacatatgcaaacaatataatatgtacttagctaaaataaaatacaacactcccatatatcaagaacctaggactggatgagacatttcctagtaatacgaatctagacagcttaggaaatgttccatccaatcctagattcttatattttgggaaggagggagtatcatttactcccactaccttgtccaactaattagcatatatattgctacatgtcaacaattaataggggtgaaaatgctactgaattaccctttttatcagtataccattttcatctagaatttctgaaaaaaaacatattgtactgataacccatgaaaataattacaaaaaaacataattccgatagttctgttctgctatattctgatgttccggtaacactgacatcgtttttgtttctgtctctactcttttgatttcgtttttgaggaaaaaaatgtttttccaactgttttcatcctcttaacaataacatgtgttccctactattgtagcgtataacgtctgattggctgcgtccttctacgtttgaaggggacctacaatatatcctattctttcacaagctgatggataccgtggagtgtggtaacacagaagatacagttctagccaaagccatcaccattgcaacacaatcttatcagaagatgctgtacttccaaattgaagctgctgtgcaagattgcttggagcttcttaaggaaatggagaggatgaatgatagatacgacttctatcatttcattgcatctgagatcctcttcaacaacaagtcatatgaagatgtgctcaagcttatacgcgatgggcatgtagagttacactacacgcttaaagagttcagcactccccatgctgatcaccacatggatgatttggtttgtgctattttcaaatagacaatctaatgctcttgtgcctataatattcatatttgtttgacatttgtttgtaggttcatcgccttgtgggcaggactcgtgcttatgtatgtattattgtatctaaatatttcctttttttattttttttcttaggagtataaaatttcgtctcctttcattcatccagatgcccacagatgcacaacgagagtgtggaatgttcaaggactgggtgtgtcagcaggttgataaggaggtaacttcgttttatgccaaatctattgtctatttttgtcgcataatggtgtctaattcttttgtttcttctgtccacagtatggatctcttggttatctttacatgcattttcttgataacaagatgagagcttggtttgccccatttcctgaaggtaaaattctcaactaaatttcatccacaatgaaaaagtaaaatctattcccttttgaaagtatacgatattcctttttgagggaattctaggatattctgtgccattggattgggtgcaatagtctcagccaccacctctttttcactgcatgaaaagtaaaaaaattgcacctacaaaggttcttgctatgccatctttgttgatgcttgttttcacaagcataaattttccatcttgtgattggataacaactgcatgccactaggctcttcttgagtaatggcaaattcttgttcttgagaaattggctattatccaatatatgattggaaataatgatttatttttctgttttcatatatacaaaaggcaaaaaaattacatattggactctttgcagacctcaattccagttacatttggcgtgctacagtcacatctataaatcgaaagtaattgcgcacaataactgagccaagggaagagcttattatctagatatgcaaaagtaattggacaaatggtgatacgcagaagcacccataaatttgtttcagggtgccactaatttgaatggttctagatttttcatttgcatggttgagcttcattgctgcctgtcaaaacacagctgcagttacttatctttcgtgttttccctttttcagtgctgaaggatctgaagtactctgaaactcatgaatgggttagtgttgaaggcgattatgcaacaattgggatttcagatcatgcccaggtacatatttagatgttctatcactctgagcatttttttttttattttagggcctcagtgtgttgaatgatccatttgcttcactctatgcatgtacacagagcatgcgttctatttcttaaacgttattaggtccaacatatgttaccatattcagcgtatagaataagggcttgtggttcttaagtttattttattttattttattttgctctcaggaccatttgggttatgttgcgtctgtggagctcccagaagttggccaaagtgtatcccagggaaataaatttggtgttgttgtaagtgtgaagggaaccaccaggggtattaactcaccagtatctggagaggttgttgaagtgaatgatcaactaagcgatttacctggattggtaagctgtagaagttgagtatggtaaaaaacgctttaataacctgctaactgttttttttgtcgttacctgcataggtaaatgcaaggccatacgagacagggtggattatcgtggtcaagatcagtgattcaggcgagctcaattcgctcatgaatgacgaggattactcaaaattttgcaagggagaaaaagacaagtattgaacaaattgcagtgagtcttgatccttgtcaatgcttgtgatgtgccatatcacttaccaatctgttggtctgtatcatgttggcattcgctaacacgtaacgtgatgctcaaacagactcaggaacatgttggaatcccttccctgtttatgttgtttaggatgaaactgttgtcgcaagtgaacatgcaagtatagcacccctaattaagctataatgatgccaattctgccaaaaccggtgtgcataatcaatcaatgatagttacagttgctgtcgagtttttgtccagtttttttttttagaggaaaactgactgtttccattaacccattgtccagtttttcaagaaataagcttgcagttctgactccatttttgtccagtttttcaagaaatagcttgcagttctgactcagttattggttatgttctggaggtgcaaaacaaagaaaatgtttgtgtaattttgtgcggcacagttttgtcatagaacatagacgacaaaatagattagggaaaacttttggaatgcataaacttggcaattcagaacttggtcctccgataaaaaaaaacaaaaaacaaaaataaggtacttctgttttatatttaagtcgttttgattttttctaaacttattcacctttgactaagtttatagtttatagaaaaatatggcaatattttcaacctaaaacaaagaaattatcaaaatatattcaatgttcaatgttaggtttaataaaattaatttggtattataaattttatattttctataaacttgatcaaattgtcaagaatttaattaaaaaaaaagttaaagcaccctataacatgaaacagagggagtactccattaggatataatttatgataaaactgatgttgttaaattcaccttcaaaatacttaatagttatgcttttatattacataaataatacaattgttatattagtaaagtaattactagtcggttgttccaaaaaaaaaagcactttatatttttgtgcatcactgcattaggaaggagaaaaagaaaagcgctaccccatgtagaaaatctcacgaaaagattgaaaactaaggcaagggagcttaaaatcttaagattttggtgataatctgaaaaaaatatatatctgattttccaactactaataacttctaatttattttatgaattgcaggactatatattcttaaaatctaaatgaaaatctgagtttattgggggagttttgacaactaaatattcagacattaagattactcctcaattgacgctccagccgaccgcctcggtgttgcctcatcttttagcctccaggttgctgctggccttggatcaaaattcaattattttactctttataaatcattcgaatacgagtctcataacatttttaatttttattttactaactaagatgccacatcagcgaaaccatatatccatactgtcgaaggatcgaaattgcatgattttgtttagtctaggagtaaggatttctagtactatagagattatttctagtactagagattaagggtctgtttggttgctgccctaaagcaaattcgcctgagctgaagcatgcctgacattttcattggtctgtttggttcaagtcctgagaaggtgctggacacaggcgtggttgctcaggctcaggcgcttgaattgggtggcctgactcaggcaaccgaattaaagaaggtagattaggtgaggttggaatattctagttgcatggcgtcatttcacaatgtttacttgtactaaccggttgagattgcaatattttatattttcttgtttgctttcacatggtttcatgctctcatgcttgtttcttgtccagggtaccaaccaaacaacaaaccctcttatatgcctgaccagggaaaacattttatagattttcttccacctaggcatgcttttttcttaggctcatcactcagggcaccaaccaaacaggccctaaggtctaaggaacttgaacaaagtcgacgtaaagttgagggacgtcaggtgattataccattgcaggttccaagtacggcccacataatacaaaacagttttcgggatccgacacgggctgaatccggcccatccaaacatgttctagacatggatgggccgccgaatggtccggtaatgggctcaatttaagactgctaacatgtggattaaaccaaacatcctcctcgtcgtcggccgtgtcattggcggcgccggcgccggcgccccaggagttctcgacgccgccggggaggcggggagctcgtcgtcttctctcctcctcctttctccgtcccccgacccccgaccaccgccacccttccatcctcgtcagcgccctctttgcagtgccgggccccttcggcatccgctgccgaccccgcgacccgagcacatccgccggcggcgcctctccgccacctatctccgactactcagttcacgctggttgcgcttgcgcacatcctgactaagggcacctgataggtaaaatatttgggacttaagtctcagtttcccccacctgaatttcattaagaaatgaattgtacaggattttccagattacatagagaacggatttccatcttgcatttttcccctcatatgtagcatggcaacatatcctatgcacacaggccctcacgtgtacacacgtgcacaccaactaaaaaatgtcaccaaaaaatctagaaaaaatcatacacatactttcaattgtattacacctagggttaagaggttaaaatcttaacgtcaaattcattatattttagccgtaacaaaaaaaaaacaaaaaatctgacagttttaaggttgcaattttgtcagaattttatcttttttgttattctctatgtagaatgaatttgaagatgcgactttgcacgtagatgtaatactattgaaagtacatgtatgattttttctaaaattttttgtgataatttttagttggtgtacatggtgtgtacacgcgagggtctgtgtgcataggatacgctcccatgtagcatatagctcatgtcaaatgtaaagtttgttttgatatggagcatgtcagtataaattttttttgcaccaaaatccaggatttgggacgtttgaagaacaaattttgtgatatacatgacatgactttactatttgcgtcatttatgcagcttcagcagaatattgcagtttgatagtttaatctgttttcgtttcattatacctgtatatttccaattctgtgtgttaccgtagatctagcagagagcaggatcttttgtttcccgaagtggggcagaatagagcacaccacaccatcacgcccacctcctcctttttaaaggagggaggtactggggattgtcactgtgatcgtgagctggagttttgcatctgtgtcagcaagcaaatactcaacaatgtgtacaatgtgtgttgtttaccttgtcagtaatggaacttaatctcattatactcgatttttattatttccaccagggcaacagtgattagttccgtggaaaaggacttttggatacggtttagctaaaatggcaaacatgaacataaccaccatcttggagaaggtatgggtttcactgatctgcatgtgaactgtatacctgaattttgctctttatttatctatgatttgattttaacatcgtcgtgtaaaatttgctttcagatgacagggaaagataaggactacagatatatggcaacttcaaatttgcttagcgattgaacaaagagggcttcaaagctgaccaagacattgagccaaagttgactactaccgttcttcaacaactggaagatacttcaggagaagtctctggtttagctgttaaatggtatgcattaagtgctttctccctttattgagagcggtatcgtcttattagcattttgttttgttaatggtgatcatccgctccttcctgcaagaattcgctgtaatttggatctcgctacttttgtaatttatgttaggtgcagttgctattgttaaggatttgcactgcctcattcaattttctggattaatataggacattgattattacagtagatgttatttttttctgtatctctctaactgctgtttttttcactgcatcttcatgtctcaattattgcatccattgaagcacatttagtatagcaatttgatacccaattgttctgttatgttttccacattcctgtgttctgcacttcatggtttgctatgttaatctgtattattacttctcttggttagcttggctccacttgtcaagaaggttggtgaggatagtgtggtggagatgaccaacattctttgtgataagttactcaatggaaaggaccaacatcgagacactgctagtattgctctgaagacaatcattgcggaagttacgacaacaacacttgctgaaaagattttggtgtctcttgccccacagctaatcaagggcgccactgctgtaagttcttaattcgtctcctaattgtggtaaaacatgcttccatattaatcttgcggtgtgcgccattcgtaccatgtagtttgtatttgccgttacaattgaaagtttcagcctgctaattaagtttaccgcgtttctgatggtgcattctacttttgtgaggtgtaataccaaagaacacatttacaaaccttgtaactatgtatttatttttacctccctattcatccagtctggttaggtgtgcaaccatgtttgcttgccatattcaatttaaggctgtgtttgttattgggggttgggaacccttctcctccgcatggaaaacggagcagtccattagcgcgtgattaattaagtattagctatttttttttcaaaaatagattaatttgatttttaagcaacttttgtatagaaactttttgcaaaaaacgcaccgtttagcagtttgaaaagcgtgcgcgcggaaaacgagggagaggggttcggaacaggctgaaatgaattcagcctaagtcattatatgctggctagtatcataactccagagttatgttatcagcacagagagccaaaaagaaagtgtgttttaacatttgtttctagtttgagagccatgatagtaagtggcatagtacagtaccttccgctattgcagaaagttggatagttttccagaccagtcaatattgctagatttttctagccaccataaatttcaaaccgcaattttagctactgcagcaaatacaatgcaaatggtaaaccacgagcaatcttttatttggataaattaattaggaaactgtgatatccttcctaacacaagacagattttagctgcaaatctggcaatgtctagctatccacataactataagaacacctttcacctttacgtctttaccttaaaaaaaacaagagcggtttattgaattacttgcctttgccagcacatcatgtttaacacctgcctataatagataaaccaatatacggattttggggcttagtagcaccaatatacggattggggcttagtagcatataactggttttgttataccatgggatgtcttgggtaggtttgataactcttcttctgttgacagggaaaaagtgcggaagtgaaatgcgagtgccttgatatattgggggatgtacttcatagatttggcaacttgatcacaaaagatcatgattgcatgctgactgccttgttatcccagttgagctctaaccaagcaagtgttaggaaaaagtctatttcttgcattggtaagtcgaactgatgtgctgtgctattatatgttgttttttgcgtggcttgagtttgtaaaggtgtttacactgactgttaacatgctatttttcttcagcatcacttgctgcatgtctgtctgatgatttattagccaaggcaacttttgaggttgtccagttgcttaaaaatagaagtgcaaaatctgaaattgcccgaacaaatatccagatgattggtgctctaaggtactttggctttcaactgtacatgtatgccttgagtagttcttttgaggaacagggcacactcatttgttcgcaatagcttagatgagatcatgttcacacttcaaatttatctagcaagttgaaatccagatatttactactttttggcgatttagtggttcttatctggtgtgctgcaatccaagttttgattcaatatttgtttcatttacagtcgctcggttggataccgttttgggccacaccttgctgaagttgttcctttgctcataaactattgtacaagtgcatcagaaaatgatgaagagctctgtgaatacagcttgcaggctagcaattttcttctttccaatgttacatgactaacgagtgttctcttgtatgactcctgtggtttttcccataatgtaggccctcgagagttttatgctgaggtgtccaagagatatatctccatattgtgagagtattttaaatcttgcattggaatatataagctatgatcctaatttcaccgatagtatggaggaggacactgatgatgaggctcaggatgaggaagatgatgagtacttaattgatgctcttacagtaatagataaatgttatctgtttacttgatcaaaatatgttttcgatattttctccagtgagagcgcaaatgaatacacagatgatgaggatgcaagctggaaagtccggagggcttcagcaaagtgcttatatgcaattatagtatctcgtcctgaaatgttgtctaagatgtatctggaggtatattgacataatcatgttaaaccaacatatgattatctgaaaaatgttctgtttgatggcatgtttaaatttctcccatgtttcagacagtgtttctgtaatgatttttacccatttaactttgagtgccccatttaactttgatgtttttattttttaaaatatatgcaggcttgtccaaagttaattgaatggtttagggaaagagaggaaaatgtaaaggtaattgctttgtatcaataatttgtcagtctctgagttgtctctgagttgtctttctgtttgtcaatctgatgaagcttctatatgattctagatcgacatctttaacacatttattgagttgttacgccaaactggtaacatgacaaaaggataaggtgacattgatgagtctaggcaagtctattgtgctcttatttgcatcattattttcaacttttccaagttatagcatcttatgcagtttattggtgaaatacttttacatgcttgaagttgattctaccatgtttagagcactgagcctatgttggcaatccttttgcttttcagccctagatggttgctgaaacaagaagtacctaaggttgtcaaatccatcaataggcagttgcgtgaaaaatcaatcaagacaaaggtgagctctttgactgcaaatcatgtctatcgacctggttctgattttagataaaatttcaggttggagcattctctgtattgaaggagcttgttgttgtactgccagactgtcttgctgatcatattgggtcacttgttcctgggattgagaacgctttgaatgttggtgattcccattttgctaaaaaagattatgtgcaggacttctacttgttgctaacttgttttctttttcataggataagtcatctacctccaacctgaagattgaagcccttgtatttacaagacttgttatggcttcacattccccagctgtgtttcatccatacatacaggtaactgtaacatatatcttcagtaaaatatacttatggcatttgtcatcattgtattgatcgtagtgaaattccaggctctttctggcccaatattgtctgctattggagacagatatgacaaggtcaccgctgaggctttaagagtctgcgaagagctagttcgtgtacttcgtccaaattctgaggtcaatcttgtatttcatatgttgctgaacaaaatctaagttctgtttcttgaagcctttgtttgtttgtgatacagccacactctccagattacaggccatatattggtccaatctataaggctatcttggcccgcttggcaaatcaggatcaggatcaggatcaggttgagcaaaattaacacctccctatcctcatctgtctctttctctctcaggtctcttatggaaatatttgtttcaggaagttaaagagtgtgccatatcttgcatgagccttgcgctatccacgtttggtgatggtctccaaagggaactgccggcatgccttcccgttcttgttgatagaatgggtaatgaaataactagacttacagcagttaaggtaagctaccgactgcacctttactgacagatagcattgctaatctccttattgattcattacttatgagcactacttgttttctttaacacaattatgttttagtcttactttacttgttttatggaacacaattttgttttagtctcaggttgaagattttagtaggaaagaatagttaactaaacccacacccccaagcgtatctcaatattctggtcaatgatgttaaaggaactacgagtgttttgatcaatgctggtttcacatatcggtagattgcctgaaagagaaattgtgttgtagttggtccattgtgatgcaaacttagttgaaacgtatttcaccaatctatttgctcagatcatgtcctcagaattttaatgatataacttattatcacttgcttaatgaaacaagatggattcatactatcggcgcagctgctacttctgccatctcacccatctttcaccttgctttgataccaattgttggtaggatcacttctgaactacactatagtaagttgaaactgagactgaacatgagcttaatatatatacactatatgtatgtatgtacacacacacacacatacatacatacacacatacatatacatacatacatacacacacacacacatacacacatacacacatgactacttggcttactgacaagggacttatagcttattgaccaaggaaaaacagacttgacttactagcaggtcttagcttattggagaaggaaaaaatctattgaccaatacaatgcttactagctaaggaagaactactactagtactgattcagagattatatggtaacactccatgccattttacctaacctattttcaccatgtgtgcacccccctcaattcaaattcagacacccacattagcttaaacttagcagagtaaattaaacaagtggcacccccctccatctcattctagctccgcccctgggaagaagcgacatcagaggcgacgctgtgataggagagacgcacctgatgcgggtgttacgcttgtttctttgaccttgggctagtatgaaggttattgggcttttgtgggatggcctactaggctaattttcttcctctcccttttctaatcgctgctaatcatgaaggttatggcgtccccgcaccttagcgctttacccctatagcggtaatgcgtgggtgggttgccccagatcgccttaccatcttgacaaccatgatgttcgaatctaattgtttagccatttgattttgtagctgtgaattttagaagtcacagtgcaatgtatcctgtgctgaacaaccggccgattttgaacagtagaaggttactgaattgaaggaacaactccataggaggaagctatcataggcttgaaggatgatcttgttaagaagctcgcggaggccctccacagagaggttactggtagtgatgaagaattgcctgtggaggagcagaaagaggacataactcttgtttcaacggattcattagaaagaggactatgactacgcaccgacatgccatttgaaatttttagctactactattagctaatgcaactttagcagcttgtcagtaggaaacgccctttgactactcatgcattttggttcatgcatttagtgaataactttttgaaagttccttattatagaaatatgtttcattgtaggattgatcaacaatattttaatccatactttttttgttttgtaggagatagaacacaatggacaacctttaggattagtgaaatcgccatcatcagtagtagaatagaatgagcaggtaatttctccaattccttggaacatgctatcatatttctttatgattattttttgtttatctcattatgtagtaattagtttagtttttataaaatatatatttcttttgtcaagttagtttacttgtgaaatctctattgctttttgttaaactctgtgttttcctatccttaactgttaagcaaaatttactttaggacactaaatatttgtggcttatgctttaggacattttagttttgtggtgatttgcccaaaaaacaatccgatcattattttaatttatcttcttcaaaagcttatgctttaggatatctttgttttgtggtgttttgtccaaaaacactccgaccattattttaatatatcttcttaaaatggtgagaaaatatggtataagagaaatttaaatttggtccaccttgcaagataattcttgaacaaataataggtacatgcaaacatatttttgaaaaaaaataagcaaaacttatcccatatttgtaaatatgtgaattgcaaaaaaattaaaactgaaaaatattggttgaactttaaacgttttaaaaaaacaaaatttaaattgtgaaaaaatattaaccgaatttatttttaataacaaattttaaaaataaaaataataagattaatgaatttcgtaaatttaaagaaccgtgaaaatagaatttaaatgaatttattttaaacaaccttcagtaaattgttgttgatttttacaatttgggacaagtttaattttgcaaaatacgttttgttgagtaatatttgttataactagatgatgccccgcgctttgttgcttgatatatatgttagatattgtagaaatggtgaaatgatttggattgaaatattgtgaaaatgatttgagaataatgatttagcatgtgtatatttagttttagaatgaaataaattgtatatataattactatgtgcttgcatgttgagctttgtatgcttagtggattgatgtggcatgcttgcatgttagattttaggagtgctaataaatactatgcttgcatgttgagctttaggtgtttagtgggcattagctttatagatgaatggattcttgcaaaatggcctaggattacaattgtcttttcaaagtctttttctctctattttaagaggatatatgaagataatggtcaatgtgttttctagaaagtagtggcgggtttaggaattttttactaagtgttcctactccgcgctccaaattcttttgacatcatgaactcaatgttttcagcccattaattttcttttcgtgttggtagccccatcacatccttaccatccgtaagtaaagtttgaatccctttctaaagggaagtagaggtggtactagctatgtggactacttaaaggaaccgctcacatacgcttccaagtttgttagcataacacaaacaaagagctaggtgttctttttgtgaaatatcactacaacatggcaacggtgttggtcaccggtagcctggcatgcctcgaacagttggtccaatcgacaacgtgtcggcagcgagtagcatggcgcactagtagggggctcgccgactcggggatgggtggcacgatggcaagcaacaaatcgtggctggggcgacgtgggagtgtgggcttctttgtttttgggttgagggttgggccgaggggtggtaggggggggggagtggggggcggattgtgtttgtggactagatttttgggtggtccaagctgctcgcaaaaaactagtgttaaaagtccgaaagagcaaatgccacaaatcttaagtgttgtggagcaaattttgttgaattgtttatctagttagtttgttcgtttgtttcttgttattactcattttcacaattcattattcatcaatgttttcattattcagatattagaaagtattgatgatttgacactaataagatatctaattaagtggattcctgcccaaccttgggccgatggggagatttatctgtattctccagatacacatagttggtcttctcaaggcatgaagatgaaattctttatcatggatgaaaagtataatatggaagccaaagggatttataagaagattgatgagttggtcagcctggctaatcattcaatgtttctggctccagtgtttgctttgcatgataagaagatcggtcgtattattctgtgttatccaaaatttgatcaactgcttaaagattggctgcctgctcaagccttttaaaggccggtttataccacccatatggatgcatcttataaagtaagtataattttattcattctatttttgtatctctctcggttgatgtgatacttatatcttgctctatatacacaaattctatttttgtatctctctcgattgatgtgatacttatatctttctctatatacacagagatgtcatatcttacatgagcaacattgataacttggctgcaagcttaggaagtattgactcatatgtgttggagacaaagcccgagagaataaaggtcatcctttttccttttgagtcaagagaagtaaattggcgaaaagattttgctacatttctgatagaacatcttcggaacaaatggaaatccaccatgttggatcacttcatcaacatcttacaaaaagatttcaagtacgtaaacagtcatatcgtttctcttatgcttttgcttatattagtaacggaaaaactaagttgtgagcaaaacttttatatacgtgtacttattgattcaaaagtaaatattgtaaaataaactatgatgaaaaaaactacaaaaatcaaatacaaaattaagttctagaattcaaattttggcttataagcataagtgaaatggtagggctgaaagagtcctgttgtggtggcagcgaatctgtcacccaccattgtttttttgtagttcttacaaagtgctcccatatattttttgatattatgaaatagtttggtatttagttcaaacaagtaaataccatatgttgataagcaaactagtgatactaagatattttcaccattgttttttttagttcttacaaagtgctcccatatattttttgatattatgaaatagttcggtatttagatcaaacaagtaaataccatgtgttaaggtaagcaaattagcgatactaacatactccctccttcccacaatataagggattttcagtttttgcttgcaacgtttgaccactcgtcttattcaatttttttttgcaaatataaaaaacaaaaagttgtgcttaaagtactgtagataataaagtaagtcacaaataaaataattaataatttcaaaattttttgaataagacgaatggtcaaacgttgcaagcaaaaactcaaaatcccttatattatgggacggagggagtatttgataagaaatatatttttctatgacatactccattataatatattttctcttatccataccaaaatatagacatttagctaatatctctaaatatatcatgtgtggtttctttttatagaattgggtacattcaacatcatccgttgttgcaagatttcaatcagctttctaacatgataaggatgacatggaaagaatctaagtatttaactgttgagaggagagtattgctatcttcaacattaaatgctattaggaacaacattccatggacatcagtgacaactatggatgctgttgtgaatgaatacatttctaaagcaacaaatgactccttgggcctctttatggaaattaagaagatagcagcacattacattgaaaaccgccgaaaactgaacaaagaaaaaggggtaagtataaaaaacattatatgtcataatataacaatgcattatattaattccaaataagtttaattttagaaattaatttataatgtcataaatgtttgattctaaatgtgcattttttgagtgattgtagatatgcaataggaaacaggtacatccaattgagataatcgaagaaatctggccaggtgctattgaagaaatttatgagcttagtttaaaatctgagtggctcatgacttgacttgtgaatggtgagagtgaaaatatcaggtaaatgcacagaactatctatgtgttgaaaaattctgcaggaactttcaacatagtacctacagatcttgatggcctaattacaactatgtgttttgtcccacctagcatcttgctatacccaatagcagttttcattgcaagtaatagtattcttgtgttctttttgtcacttaaaaattaaaattagttttggggctgattacaattgacttcttttagtacgtacaattgtattctttttatactacataagtgattttacatttaactgcatgtgccttttggggggcaacatacgatttgctttagtagcccttataaatgcttgtaggagtacgcagaagcacccataaatttgtttcagggtgccactaatttgaatggttctagatttttcatttgcatggttgagcttcattgctgcctgtcaaaacacagctgcagttacttatctttcgtgttttccctttttcagtgctgaaggatctggagtactctgaaaatcatgaatgggttagtgttgaaggcgattatgcaacaattgggatttcagatcatgcccaggtacatatttagatgttctatcactctgagcaatttttttttaattttgcgtaaaccttattttgcttcatgatactgtcaccttgcataaaatggatttaccaaaatataagtcagatatataaggatgatgatagatactgggaggggcagttccaacacttactactagaagggtagagggtatccatgactgcaagtgggaccctttacatacagatataatataaggaataaaatcactcacttgtatatgtgtgccgtataaaaatcgtgtcaaccatgtccttgtcgcaaggcgagcaacgctttgtattttatcaagtccttacactccacatggtgcgtaatgatagatagtggtaagatggaagatgattttaccccatagaacgttagtacttggatttggatgggagatgatataaaccccatcaagatagtagcacgtggtggactagagtgtaatgtgctgaaataagagaagtgcattgtactctaaatattacaaatacgcgacttgtaatatatagagtgaatatgggtacagtgatacaagcctacacagtgctcaattaaatcgtgattcacgcatgtctcttggattagaggctacgggagcctattgtggtcctttctcactatgcaagtgattagtagtttttcttataaattaaatatggactcttcttacaagaatatttttttttgaagaaattataattgagaaatgatgaattgatatgatttatgaaatcgcatgccatacatccttgcaattaatactgcttgctgagtgcttgtactcacccttgctactaaccctccttgtttagatgcaaacacgttcggcaagctagcgagttaaatggtgggttggaagagctctacaggaaagatgaggcagaactagctctacagcaaaagatgaggcataacttggttgaacgtttttttgtttctcttttttttgggtgaggggatcgccttttgtttctattgcatgctatgtaacggtggagagaatcattatcttcactatttgaaaaatgattctacagaagatgattgttttttatggcagtgcttgaagggctctgcttcgtggtaaaaaagaacacttgcgaaatgttggatcatccttgaaccatttgaaacagatttgtttttttactgcctaaaatcacttgcaaagttcttgagcaatttattttgtttgttcagttaaatcacatagttggcctttactgttgttcaagtttttttaattggttacacattttttttccgctgaaagtgctagattgatcagacgactgaagcataatcacgcatgttttgatcccttctgcttccatgagcttgctagtcggttctataatttgtgatcagattgttatacactcactgtatgctacaaggtttctgtgtatgtattcaaatttaacattcatctactaaaaaaatatgttgcaatgtgtaggtctcatctagtagattaaaaatcaatgctagatcactggaattttacctcaaattttcatggaaatccatttttcactctgagctacaaaaccggttctttttcactgttaacttttaaaacctagcatacatgccaatatgcgattgaaccatcgtgttaaacctgttagtcaaaacagcacaatcctattcaaaaatgacaacgttattctactcctaaaatgattgtcacaatgaaatttgatcaaatgtgatgaaactacaaaggtcataaaattacacccaccaaaaatatcacgtatttttttcaaactagaaaccaaatttgtattcttcaatcaactacaaacaagtcgggaagagaggtgaacctgtccaaatcaccgaaaaaaatagtcatttttacccaaaatttgaaaccattttttattttttagtgaatttcagcctaatttggtgtccactaaatttgattgaattcatatgaaggtttcactttttgttttcaaatttggttgaaaatttggaatttaagtgatttgggtaattctctccataaataaatcatacaaccaacaaaagtcgatggctgagtcaaaggacttcaataaacaaatattcagtcaagtacatggcattttaacataagatcctctgtttttctcttttcttctagtagtataaaatagctctgggtgaggagttcaacttaaaagtcggtagggtatttgtcgggtttaaaccacaaggagaaatcaattcctttcttcttaagatcttctgtggcagggccaatccgatccaaaagctgcaagtcaagtaacagggttgatcagcaactccataaaatttctccaaaagacgaccaaaaattatcattactcttggtgatgcatactactaccgtctcacaataggttcatttttcactagtcccacatatatcaatataaaaccaaaaagactacaatagccccactttatcaaatcccaatacggttattcttctttttatctactccgaatgaatttatctcctactttcacaaactccaatacaatgattgctcaaaataaatgaacttattttgagacaaacgggatgggcaaaaaataatcttattctgagatagagggagtacagcatatacacactgaacaggcagcctaagcctggaattctcctacaactagtatgataaatctttcggttggaattcttaagttcgcacggttggaattcttaagttcgcacaattggccctttagtggtatgacaatgaatgcttaagatatgagtattgtgatctttagcatgagagaacaaactacttgttaagacttaagaacaaacctgatcatgtacaacaccattggaaacaaggacagaacgatcaaagacggtaaactccccaccatccatgcgtgacaccatcccaccagcttcttcaactatctgtagtaaaaaaaaatgccgaattcatcaagtaattatactgaaagtgtgcataactttagcccaactatcaggatttggacgatatgaaaaggaactcataaaaatggattatatgactgaaaatgtgtatttaagattgaacaaaacaatcaaatccttgtttttactgaacttggatatcttttcttttatcaaagtttaattccaatcatgaactgcgggttctgatagggtaaaaaaagattaccagaacaccagcagccatatcccaaggcttaagtcggtattcccagtaggcttctgtaatgcctagggcaacgtgggacatgtcagcagcagcagaacctagtcttcgtactccctgaaaaaaaataataaaggaggataaagcaaaagtcaaagggggtaaatttgttgtgtaataatgaagggagaattcactttaccctgctaatgtctgtgtattccttgaacaaatttatgttggtcacccatgcatcatcatgttcataaccaaaaccagttaccagaagtgattgttccacctagagaatcaattagagacaatatctttcttcagtcaaatattctgacaaaattaaatcacaagaactctggttgcatccagaaccactacaatcaatagatagatacactgagcgtatgatcaaagagagattcttatggcttcataaaaaaagagctattatgacacgcatatgcgtgcgtgcacatagcaacatacttgtataaaagaaaaaaaaagttaccttgtctgtcttactgacatgaatcttttgcccattacaataagcaccaccaccttttcaaggagaaaggaaaaccttaaaaataattctgtagtgttctataaggaaaaaaaaagcattgcaactacagtgtttgaccaaagattataccagatgatgctgaaaccgtacgagtgctccagcacataggaccaccacaaaattcgacctaaataagggtatatgaaatgtgaataatccagagggatgcaatgaactagcatgggaagtttgatgatccaattgtgtctccggcgtttaatgaatcatatgattcaagaaaaacacatgcacatacataccacagtggaagcagcaggctttccgcgaaacagaactccaatggatacagaaaagctagggtaaccatgcgcaaagtttgttgttccatctaaagggggtaaaatcactgcattagatcccccaatgaagaatactacagaaaaagtctaagtttccactgcagtaatacaagttcagataaaccttcagttaaaaattaaaatcaatgtgatcccaatcttgtttcaaatttatgaacagttcaaatactctaacatccatttatatgaaaggctttttccaacatccattctcctaccaataatactatatactagaactaataacatcctgttcagttaccagcccatgcaatcgagcatgttgcctctactaaatcaaatatttcagatacttaatcaagagagcatatggaatcacccagtattcttaaatgattactaaatgatcaaactccactacaggaacaattggttaatgacttcatcatagtagaattacaaagtacttcctccgtttcacaatgctagaatgacttacgttgtgaaacggagggagaataaagtggccaaacctaaaggatcaatgcaccagagatactccgacaaggcatctccaataagtccaccttcctccccaagtatgaggtggtctgggaaggtcttcctcacaacttccagaatgaccgactcactcaatttgtctgtgctgaacaaaagtagagaacacactaaattcaaatgctaatgttttatttagattatagagatacatagatcataaaatatgatattagcaagtagcgacatcaagttccaatttacaaagcatttggagattgtaggatgataacttttttcttttgaaagatcaagaatgataaataacaaccaagttagcatcagatggggaaacaacaacacaagtaagaagcatccttactctgtgaccaggtctgcaactcccttgtagtgaatattgcgtggcttattaacagcttccattataacctaaaatgaggagaagacaatgtaagctgccttgagaattggcacatcaaaaaatagagttaaaaggaaatgagcttagctcactaggtgagatgtgtaccggtgtacaaccccaccaccgaagtccaatttttttttagagctgggatgattacatttcaaacgcctcggcctttgcaagaaagcccagaacacctaagtttaatttttgtttggctcgattcttaattaaatagatacctaattcattctttgtatcccaccaaaaaattataagaaggataaaatgcactagcatggaaactcgagaccacggtccatattttttccttgtagagaaggctacgaagattcgatgaaccttgagcatttataacattagtgcattacgaactaccgtgatctccatatttacttgtagaatagccaatatttcaatccagttctcaacctgacctctctagaaaccaatagaatcactagttcctcacatcaaagaacattaaccataacggaaatttcttataaggtttcacagaaatatgcatcttttgtcggaaataacaagattaagcctgaattttattacccaactgctcaaccgttcatcacaacctctgaagctccaattttctgtcagaaaccaacccaagaagggagagctaccaagcaaagaacctcgaacgcacctcggctccggccctggctgcgtcctggatgacgccgaggagctccgcggccggaatcgggccggtggtgggggcggccaccttggggcacttgcccctcgcggcgggctgctccgacgccaccgccatcacggggcgagctttgccggccctggaggcaagcgcccggaggccaagaaccggtccccgcggcgaggttgtgccattcctgcggtgtgaagaggcggcggcagcggcggcggcggcggcggtgggaggacggagaagataccgtgccattggtgctcaggccttcgagaagatgtctctgctttttttttttctttcacctctgcttcgattccacatgtgtgtgcttttcacttgcaaatgtactccatggagtaatagttgctttcatttggatttgaaaaaagaaatagaacttctaaaaataaaaaaaaagtctttttcttttttttttagaattacacagtacaacctaccactgccattgcctcgctggcgaggacgtgtcgacgggtacgtcgcctaaattcgctcccatgaggagtcgaacccaggacctcggtgctactgaggctcttataaccactagattacaggtcatttcgcaaaaaaaaagttttttttctaataaaagggtagtatatttttttgctgctggtatggataatgcctatgctgcatgaatcttaatttgcgtacgcgtgtggcattatcttaagggcctgtttggcatagctccagctccagctccacccctcctggagctggagctcagccaaacagtttcagctccaccaaaactaggagtgaagttgggtggagctctctcacaaaatgtactagagttgtggagctgggtttcggcaactccataactccactccagactcaactcctggagttatatttaggagttggagctgtaccaaacaggccctaagattcatgcgagcttaatttcactttcgatcttaattattttacctggttcatttgatgatttgcttactgaatgtctcgggtatttagttccaagagaacatctcagttctattggtaaccttcaagtaaactgatatgctcttttccaccattttgcaggttaaggatagaccgcatgaggctcaaagggcacgccagatagatatttttcagttttgtcctcttgcaactcctgcacctctctactcactatagtagcagtgaccacacaagcttacctgagcttgagagctcagcattatcttctcagtcttgttctcccttcacagtttcagatttatgctctttggctgtcaagactcgagcagtctgttgccttcaccttgtgcttatgtgagttagtttctgtcttctctcaattattactagtacttgattcttcagaggtcatgtgggtttgaccaattagcacattgcagttttctgtttgatgtccatggtgaatttgtggatacaccttatggttttcaaactagtgttttggaaacaacttacatgctacgcattgaaatgtttgctttctgaatatcttgggtagaagttctcaaagaacatacaccagctctattgataaccttccagtatgctgacattccttctcccaccattttgcaggttgaggatagaggctctgttgtattatcctgtcacaaggccaagatggaaaattaatgctagtcaagatgccacgcaagaaactggcctgattgatgcagaaattaattcttatgcctatagtgaaaggaagaacaggaaatacaacggcgcctacatcgataaagatggtgtatcaaggaccttcgatcgaaagaaaatatcaagaaaaaggggtaaatgctaaatatattatctttccagttgttcttccctttgttcttttgttcagcacttctacattccatgaagtatctaatcagtatatgtttgcaagtaaattgttttccctccttcaaaatgatctaatgtcttcaggtttcatgcagggggtgctatgagaggccggggctggaagtatggctctggttttgtagatggagtcttccctgtgctcagtccaatggcacaggatatcttagaatttgttcagaagggaacagacgttgcaaaaatctgggaatctttggataacattccttccacacacaatctttttgatgatcttgtgaatgtcgctgtccaattccgtatgaacaagaaatgggatctgatcattccagtaagtctgaaccctgcacattctcatcattaactaatcggatattcacatctcaatgtttcggttacctttgatcagtattttgatgtttaatttgtcaaaagtggatataggtctgcgagtggatcctgtacaggagctcattccgtcctgacatcatctgctacaacctgctcatagaatcctatggcaagaagcgtcagctgaacaaggcagagtcaatctacatggctcttctggaagctcagtgtgtgccaactgaagacacctatgctcttctcctgcgcgcttactgcaacgctggatcgctgcaccgagcagaaggcgtgatctcggagatgcgcgagcacgggattcctccaagtatgcagctcaattcccctatattgccaagagaaagaagcttgtaggttgacatagttgcataactcatgtcaagaacaatcttgcagatgctactgtatataatgcttacttggatggattactgaaggcaagatgtaccgaaaaggcggtcgaggtgtaccaaaggatgaagagagaacggtgcagagctaacacggagacattcaccctgatgatcaatgtgtacgggaaggtcagaattcagagcacaatattgtttttcagttcactgtaaaaatcttttcatttctctttctttgaaaacttacctctgaagaatttctgacatatattttttcatggtcaatttgaaaggcaaagcaaccaatgtcatcgatgaaagttttcaacgagatgaagtcgattgggtgcaagcctaatatctgcacttacactgccctggtgaatgcatttgcgagggaaggcctgtgcgagaaggctgaagaagtgttcgaggagatgcagcaggcagggcacgagcctgacgtgtatgcttacaatgccctcatggaagcttacaggtgaatatcaaattagcatatcagtcatccatggcttcacgagcccaagtttctgatcacaaaactccagtgaaatttgatcagatttttttgtaagtttgaattagcaattaatagcttgcaacctttcaatgcacccatagccgcgctggattgccgcaaggcgcatcggagatcttctccttgatgcagcacatggggtgtgagcctgacagagcttcatacaacatcttggtagatgcatatggaagagccggccttcatgaaggtacattttgcagttggtgatggaaaattttggccaattttgtggtcaaagaaaccaagaacatgagttccatgatgctactatgaactctgaaagtgaaagcctccgaatatatataattttgcccctgtctgaactctgaatatactctctccatttcaaaatgtacgacgccgtcccaaaataaggcaacggcgttatacattttgaaaaggaggtagtagtataattttgccactgtctgaactctgaactctggaagtagtgacagcttcttctgagaatgtataaatattcggtgttttcagatgcggaggcggtgttcgaggagctgaagcagcgggggatgtcgccgacgatgaagtcccacatgctgctgctggcggcgcacgccaggtccggcaacgcgacgaggtgcgaggaggtgatggcgcagctgcacaagtccggcctcaccccggacaccttcgcgctgaacgccatgctcaacgcctacgcccgcgccggccgcctcgacgacatggagcgcctcttcgccgccatggagcgccgcggcgacgccgacgtgggcacgtacaacgtggcggtgaacgcgtacgggcgcgccgggtacgtggggaggatggaggcggcgttcgcggcggtggcggcgagggggctcgccgccgacgtggtgacgtggacggcgaggatgggggcgtacgcgaggaggaaggagtacgggcggtgcgtggggatggtggaggagatggtggacgccggctgctacccggacgccggcacggcgagggtgctgctggcggcgtgctccgacgagcgccaggtggagcaggtcaccgccatcgtcaggtccatgcacaagaagcccaagacactcttcaccatataataataaaaaaaaacccaacactttgcatatataattgcattattattacatgtataataatacagtataaatgtacattacaatactaccttagttttcttttaatgtatgccgccattaattctaaagtagcggctaaccattcatcttaattattttaaaaaaatattgtaaatatgctactatctctgttttttaatataactaaccaacgtcatatatttagggatggagggagtaaattgtaagtcataaaacatgtgacaacaaaataaataaaatttatatatttttaatagcatgaattgtcaaacgtcatataaaaaatcaacggtgttatttattagaaaatgaagggagtatattatagcatagagtataatagattgatttagcatcaactttgttgctgtagagtgtaaaacggtgttgtcttgacaaatataatgtaaacaggatgtgtatgcaatcaaaccttaaacttttaaatcattttatgtataaaaatatatgtgatttggtcaaaaagattactgtcatgtggttaggataggagtatattttttaacaaattatgaatacattggtcagataagacaattattaaaccgcacattctttctattccttagggggacttattttagtccctctcaaaaaccataaatgcttgtccctactaacagaaactattaacagtaatagttttgactcggcccactaacaatttttgaactgttaaactacgatgaacgaacgaaagtaaatgcttacaaaacactcaggcaactgatctttttaaatatttaaaaaagtttcataaaaacaaatagtctaaatataatctctaatactccctccattccataatataaggcacaaccacttttttttagatgttccataatataaggcatgcatgtatgtaggcaattaactatgaccccttcttcattaaattattacttttttaaatcctccactctcatgttctttaattctattagatacatgcattatatttattaggatgatccaaactacaatatgataataaatattttcttggtctttgggttaggggtgtgtcggtgacatgggaccgggagtatcatgacttaaagacttgaggcagacgcgatcacccacgtggcctaaccccctcggggggggggggggggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccacatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagagaggggaaaaacgatcccagaacgatcgggggctggctcgcactttgtagcttcttcatacatagatccaccaaaacacaggagtagggtattacgcttctcagcggcccgaacctgtatacatcgcccgtgtcttgtgtgtttccattctcgcgaaccttccacatacagactaggagcttagaatctcacccagggcccccggccgaaccggcaaaggggggcctgcgcggtctcccggtgaggacccccacgctccgtcatctggcgcgccaggtagggggttctgtgtgtgttcttctaagctctcgcactctttcgtgtgcgccaagcttttcctgttcagcccaatggctgaacaagcaaaggcgcacaacctctctccgagtgttagcggtgacgacggggagccaaacccacgccgtcgtgctcgtactccaccgccccctccacgccaaagtcctagacgggaggaggcgctcgagagggtcgaaggatccgcgacttcgacatccacgggtgatggaggagggcgccgagatggggagcgtcgcctcctcgtctatggcgacggcagcacgccccagggcgcgctccaagctgcgggcgcgctcctacgtcacccgcccgttgtccctgacccggagtctccagtccaacgttggctggacgacgtggccaacttggtcatgacggcacggcagcgcctaggtgctggtgggcggtcctccgccaccaagacctctggcgctgctaccaccggctccgtgtcgtcaaggcggagggcacggcgagcggcggctgttgctcgccattcggccgccactccttcgtcagcacctccgacccaggaagatctgcgtggggggccggatgcccgcatcagtatcgagcgccggcgtaatggccgacgtgctgcccatgcaacggagggcgcctcctcgtccggagtgtcacatcaacacggacgcggggatcagccctccgtgcccccggttggtggtgtcggctgtagagcctttgtggcgagccttcggaacgtccgttggcccctaaggttccggcccaccatcgccgaaaaatatgacgggagcgtcaaccccgccgagtttctccaggtctacacaaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagttttttcagctcgcggaccgagtggctcgtaaggaagaggcatggacctggaacccctccggttccggtgtggcagcttcggccgcccccggatccgctgctcggacagggcggctgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaatattgaatctccactgatcaacgctacaccacgttgaacaggcccaaccaacccacctaaactacagtgtattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggatacttacgaccatgaagcatggccagatgtctcgagcacgcagctcactctgatactaaaaaggtctaatactgcaattatcccatcaactgagctagtggtaattaagcatggctaagcataaagttctagctaggtcatcaaagtaacacaagctaggtgatttattacccaaggatgacaaaggacagatatcaagtaaacatggcacaagcgagcagataggtaaaaccctgaccccatgtaattagcaaaacatgcatatttgtttgcaaacagtaaaacatttgtaaattaggatcaacatgctcaaggggaatgtgtgacttgccttgcttcttcactttgatcttccgaactcttttcctcgcgaccgcggacttccgaaacgacggaaactacacgctggcacgcaaaacgagaaaaaactctaataaaaaccaaggaaacagtacataaaaactaaacaaacatgtagagctcaattttagatgaattttgcaagttgaatggctcaattcggagttcgaatgaattagatatgaattttagaagttttgagccattttaatggatttctataattaaactcgatttattgcgcaattattatttaatttttcaaaggaaaaaggctgccgctgacgtcatcaagtgaggccggcgccgacaggcgggccccacacgtcagcgggtcaagggaatcggtccaccgtggaccgggaccacggggtggtccaccgccggtccacgggaaccgacggcccagatcagcccgagctgatcgggcggccacgaggcagggcgcccagagcacgggcacggctcagagccggcccgaccgagcgatggcgcgcggcagcgcggccatcggcgacgacggccggcgacggcgcggggaggagaggagggatgctcaccaagggcggcgacggcgagactgcaacggggaaaccggtggcgggctcctcggggaggcaacggtggtccggtggcgtaccacggcgcgaggcggcggacggtgactgggacgaccggggcgcggagagggcgatttcagtggttcccggaggcgaggaagcggtggccggggtgcggctcggagttgccgatccgagggaggaaacggcgcagtccggcgtcgaccggggaggcggggcgacacagatggagacggcaaacacggcggcgatctcgggttggtggtgaagttggtgctcgggcagcgaggggcgacaaccgagcggcggccgagcttgactttgaggcggcgaaggtaccggcagtggtggcgcattggggcgacggctagggcggcggtggcgcgcggctgaaggcggtgaaaggggcggcggcctcgggtgtacggtgggagtggtgctcgaggggtggagagggggaaataagaggcggccggacttccccttgcggtggcgaagctggcggtggcggtggctcggcgcggcgacggctgtggcggcgggaaacggcgaccgaagctcgccggagtgtggcagcgcgtgggtgcggcgtggggagagcgagggagagtatgccgggctcgggaaaaaaatggggaaacggacgaggggagcacggggatgctttttatgggctcgggaaggcgggatcgaggccggacgtggcggaatcggccggcgaagtggagcgccgtcgtggggtggtggaggggttaaccggcgccgtttctagcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttaatttgttttctttttattttaattgatacaatgatctttgtgttattaaaactatttctcgagctccgaaaattcacggaaaattccggagagtattttagggcacaaagaatattgcaaaatattcccggccaatgatttttaagggaaaattttaattctcccattatttcacttgattaaattgattaactttttattcaatttctaggaaatgcatcattaaatgatttttaatcccgaacgaaaatcggggcgttacaaatctaccccccttacaggaatctcgtcccgagattctgggatggctagaaagaaagccggtgctgatgggcggtctgactgatctgctgacacatgctgcctctttctgattcgaactgactgactgactggtttcatcggattagatccctggagttctggtacccaacacgaccgattagctgatgaaacctatacgagcgatctggctggattcaacactgttgtcccgttgcttcccaaacctgaattgattggttctgctcaaactgacgcagactaggactgcctgtactcataaaacttacttatcttgggctgaactgtcaatactagcaatttgataacccgacaattcaccaagctggtagaagagggtgaaacttgcatctggcatttgtaactcattgatcctacgtccgcttgaacgggtcctgactcgaatgacacgtaattccaggaaacctgcttgacaagtctttcgtctgaactacaaccgtccctgatgctgcttctcaaagctgagctattgacctagcctcaccggtgtacctcagaattcaaacggatgccctaagatcggcttagctcttctgataccttgcaacaggcttcttcaagtgctacccggattgttgcagtgggttgaaccttcaactaaaacagcgatgaggtgagccaaaactcatctccgagacctaccccccttacagtgggtagtcttactttcgcctgactgagaacctttgaactgttgtccttgaaaaaatgaccaacatttctcggatttacagatgccctgactttgaagactaaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttttattcttcaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttagggtttgaccatttggctcaacctacagtcgaggtggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaatattgaatctccactgatcaacgctacaccacgttgaacaggcccaaccaacccacctaaactacagtgtattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggatacttacgaccatgaagcatggccagatgtctcgagcacgcagctcactctgatactaaaaaggtctaatactgcaattatcccatcaactgagctagtggtaattaagcatggctaagcataaagttctagctaggtcatcaaagtaacacaagctaggtgatttattacccaaggatgacaaaggacagatatcaagtaaacatggcacaagcgagcagataggtaaaaccctgaccccatgtaattagcaaaacatgcatatttgtttgcaaacagtaaaacatttgtaaattaggatcaacatgctcaaggggaatgtgtgacttgccttgcttcttcactttgatcttccgaactcttttcctcgcgaccgcggacttccgaaacgacggaaactacacgctggcacgcaaaacgagaaaaaactctaataaaaaccaaggaaacagtacataaaaactaaacaaacatgtagagctcaattttagatgaattttgcaagttgaatggctcaattcggagttcgaatgaattagatatgaattttagaagttttgagccattttaatggatttctataattaaactcgatttattgcgcaattattatttaatttttcaaaggaaaaaggctgccgctgacgtcatcaagtgaggccggcgccgacaggcgggccccacacgtcagcgggtcaagggaatcggtccaccgtggaccgggaccacggggtggtccaccgccggtccacgggaaccgacggcccagatcagcccgagctgatcgggcggccacgaggcagggcgcccagagcacgggcacggctcagagccggcccgaccgagcgatggcgcgcggcagcgcggccatcggcgacgacggccggcgacggcgcggggaggagaggagggatgctcaccaagggcggcgacggcgagactgcaacggggaaaccggtggcgggctcctcggggaggcaacggtggtccggtggcgtaccacggcgcgaggcggcggacggtgactgggacgaccggggcgcggagagggcgatttcagtggttcccggaggcgaggaagcggtggccggggtgcggctcggagttgccgatccgagggaggaaacggcgcagtccggcgtcgaccggggaggcggggcgacacagatggagacggcaaacacggcggcgatctcgggttggtggtgaagttggtgctcgggcagcgaggggcgacaaccgagcggcggccgagcttgactttgaggcggcgaaggtaccggcagtggtggcgcattggggcgacggctagggcggcggtggcgcgcggctgaaggcggtgaaaggggcggcggcctcgggtgtacggtgggagtggtgctcgaggggtggagagggggaaataagaggcggccggacttccccttgcggtggcgaagctggcggtggcggtggctcggcgcggcgacggctgtggcggcgggaaacggcgaccgaagctcgccggagtgtggcagcgcgtgggtgcggcgtggggagagcgagggagagtatgccgggctcgggaaaaaaatggggaaacggacgaggggagcacggggatgctttttatgggctcgggaaggcgggatcgaggccggacgtggcggaatcggccggcgaagtggagcgccgtcgtggggtggtggaggggttaaccggcgccgtttctagcggggtgagtgggggaaaaggtggaggacgtggagggggtcgtgtccatgtggttggatgcgagctcgggtgcgggaggtcgccggattttgcggcgacgtggggcggctcaggcggccatggcggttgcagccggccagccagaggaaggaggaggagctgacgggtgggaccgccggtcccacctgtcggcgaagggagagaaggagggacgcaaaacagacttttgcaagcgggccaaggaagaagggagccggcccgagagagggaggaggcgcgcgggccgcgggagaggaaggagggggaggaatttgggccgagcccgaaagggaggaaggggaagtttaatttgttttctttttattttaattgatacaatgatctttgtgttattaaaactatttctcgagctccgaaaattcacggaaaattccggagagtattttagggcacaaagaatattgcaaaatattcccggccaatgatttttaagggaaaattttaattctcccattatttcacttgattaaattgattaactttttattcaatttctaggaaatgcatcattaaatgatttttaatcccgaacgaaaatcggggcgttacagcggcgtgacaggaggaggaagaagaggtcagcccattccgacgacgagggtcatgtcctcaccgtcgagggcgcttcgcgggccacccgaaaggggaggcctgcgagcgacaaaaagaaggaggccggcgctcccagtagggagcgcccaaccagcaagtggtgcatcgtccacaacacctcccttcacgacctcgcggactgccgcgcagtcaaaagtttggctgagcggacgaggaagtgggaggaggagaggaggcaggagcgccgagagggcaagtccccggcggttccttctagcaatcggcgaagtgaggccaagcagaaggcccccgccgaggacatcgatgacggcgatgatgacctaggtttccaagagcccggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccatcgtgcgttgcccggggaggacagatcgcaatggtggtttcccccactgtttgcaacgtaaagctggggcgtgtcctcattgatgggggagcagccctcaacatcctttcccccgcagcctttgacgctatcaaggccccggggatggtgctccggccgtcccagccaattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcaccgccgtgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctacgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgccccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagagcccccgagccgaacggtggcccaaggcccccgacgaccggagcaggccctctgcccgcttgtcagacggtgctaggtgcccctgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactatgggaaggccgcccctgtcatcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttacactttgaaccacgccacgctatcaagagccaggccctcgccgattttgtggcagagtggaccccagctcccgagcccgtctcagtccccaaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcatcggcacgtgtccagacgggataacacggttgccgacgaactctcacggctcgcttcctcgcgagcccagaccccaccgggcgcctttgaagaaaggcttgcccagccgtcggcgcgacccgaccccttaggggagacggacgcgcctgataggcccccgatgcccgtcggagtccaggcctcgggacccgaggggagcgctcccagctcccttagattgattgcttggatcactgagatccaagcatacctcacatataagactctacccgaggactgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaagccctgcagatcataccactttcatggccatttgctgtctgggggctcgatatcctgggaccgtttaggcgggccccgggcgggtttgagtatctgtatgttgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggtgattcgtggatcgaggagttgccagcggtgctctgggcgaaccgaaccacgccaagccgagcaaccggggaaacgcctttcttcctcgtctacggtgcggaagcggttctcccatccaagctcaccctgaggtcccctcgggccaccatgtactgcgaggctgatcaagatcagcttcgcagagatgacctcgactacttggaagagcggaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctatgctgttgtttccttttgaaggattttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgagggctaggacctgggcacgagcccttgttcaagccaagacacaaaaggaccgcggcacaggcatcctcgtctcatacacacaacaaatagaattgacaaaaaatttcctctttatttgattgcagattaaattagtctatacaagaagggggcccgaaggcctcgaaagaagaaactatttaaagattggcgggggcctgggggctcactccgatgcacccgggtcgccagcctcgtcgccactgtcgctgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacaaaagcagcagcagcggaaaaaggcgatcctagcggggcttcagctccactccacaggcaaaactcaactggggtctgagccttggtcttctaacttcgtcttcaactcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgctatgggtgcgactcgcaaaaccatgcacccacagcccaccattcagtcgcattttagttggataattacgaccatgaaacatggccagatgtctcgagcacgcggctcaacaagatactagaaaggtctaatactgcaattatcccatcgactgagctagtggtaattaagcatggctaagcatatagttctagctaggtcacataagtaacacgagctagtcaatttatcacccaagtttgacaaaggatagatatcaagtaaacatggcacaagcgagcagataggaaaaccctgatcccatgtaattagcaaaacatgcatatttatttgtaaacggtaaaacatttataaattgggatcaacatgctcaaggagaatgtgtgacttgccttgcttcttcactttgatcttccgaactcttttcctcgcgaccgcggacttccgaaacgacggaaactacacgctggcacgcaaaacgaggaaaaactctaataaacaccaagaaaacagtacataaaaagtaaacaaacatgtagagctcaattttagatgaattttgcaagttgaatggctcaattcggagttcgaatgaattagatatgaattttagaaggttttgagccattttaatgaatttctagaattattaccgatttattgcgcaatttaaatcaattatgacgtcatccgacggggagaggtggcgccggcaagcgggccccacctgacggtgactcacgggtggcgggcgcaccgtggaccgagtccacgcacgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaaggaggatcgggcggccacgggcgagcgggagccagctcaccggtcggccggccgggagcgacggcgcacggcccgatggtcgccggcgacgaccaccggcgcgacggcacgcacgggaggcgacgaaaagaggggaaagggaaaggagatgaagggggtcctcaccgaggagcgccggcgacgggacgaccatggggaggcgaccggcggcggaaaggatggcggcggccgacacgggaggcgacgggaacggcggtccgacgacgcccgaccatggcggagccgcggccgagggccggcaagacctagggaaattattggagcggttagggagggaaataggcgaccggagcggcgagaataccacgccagagaggagaggaatggtggggctcaccggcgaccgagagataccacgttccggtgggtttccggcgatgaacaacggtgaccgaggtgctgcacggcgctgcgaggcgagaggtgaagacggagcgacgcggcggcggctaaggcgacggtggcacacggctggaggcggcgtatggtggaggtggctcgggatgcacggtggaagcggcgttgcggcggtggattggcgaagaggagcggtggacggggtgcgcacggcgactgcggtgccggggagggcgacggcgcagtgcggggtggacgggagcggcggcgcggcgctgctggagttcgccggagagcggcggtgcttgggctcggcgcggggagagcgagggagggcgcggcggcttggggaaaatggggaaaatggatgaggggagcacggggatgctctttatgggctcgggaaggcgggatcgaggccggacgtggcggaatcggccggcgaagtggggcgccgacgtggggtggtggaggggttaaccggcgccgattttcgcggggagagtggggggaaaggcggaggacgtggaggggatcgtgcccacgtcgttggatgcgagctcgggtgcgggagggcgccggattttgcggcgacgtggacggctatggcggttggggtcggccggcgagaggtaggaggaggagctgacgggtgggaccaccggtcccacctgtcggcgaagggagagaaggagggacgcaaaacagacttttgcgagcgggccaagagagaggggagccggcccgagagagggagaaggcgcgcgggccgcgggagaggaaagaagacttgggccgaaaatggcccaaagagaggaagggggaaattttatttgttttctttttattttaattgatgcaatgatctttgtgctattaaaactatttctcgagctccgaaaattcacggaaaaattccggagagtacattagggcacaaagaatattacaaaatatccccggccaatgatttttaagggaaaattttaattctcccattatttcacttgattaaattgatttaacctttatttaatttctagaaaatgtattattaattgatttttattcccgaacgaaaatcggggcgttacagtcgcccactccgccgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgccgctacgcgcccttgcatccagctcccttgcctgcgcctcgagttcagcggcccgctggttcagtgcggccctctcggcgcgggcactttccagattgcgacgcgcttgttcctcttgcgcagcctcgcggagggacaggctgtccgccagccattgcgccgcggcctcggcctcctcgagagctcgctcccgctcggtgagcgcgtcctcgcggaggcggagcgcggactcttcttcggcacaggcggcttcgtgcaccgccagtgtgacctcccgaatagcaacggcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaagacggagggtgtcctgcgcctcgttcatcatggtggtggcgatgagggcagccccccgctcctcctccacctccttggcgatctcccccagcaccttccgacgggcttcgagctctgagacgtgccggcggtgtgccttgcggcccacctccaccatggcctccaccgagcttcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggcctccccggcttcccgtaggcgatccgcggcttctcgccggtcagattcccgcctccgagcctctgtggtcgccgggtcctcggcctcagactggccggacttggaatggcgggaggaacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaatgaggtttccccgggatggttctgtcccccccatcttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcgaccgctccccgggcccccgtcacggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcactgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaatcagtcgctcttccagtcatcccacttcttgcggaggacgcagggaatgtagcggttcagcaccggcccccgcggctggaagtagcaaccaccaaccaccgacggcggcgacactggctgtacggtgaagaactaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagccagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgaaaggaaggaagcaaatctcttcctcgacgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaagaagtggcgtcacgcccgaccgcttccctcgaggagggcgatcgccctggcataacgccgggggctactgtcggtgacatgggaccgggagtatcatgacttagagacttgaggcagacgcgatcacccacggccgcccttctctttgtctccccgaggggtcggaccgctcccgtctcggccgcgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagagaggggaaaaacgatcccagaactatcgggggctggctcgcactttgtagcttcttcatacatagatccaccaaaacacaggagtagggtattacgcttctcagcggcccgaacctgtatacatcgcccgtgtcttgtgtgtttccattctcgcgaaccttccacatacagactaggagcttagaatctcacccagggcccccggccgaaccggcaaaggggggcctgcgcggtctcccggtgaggagccccacgctccgtcagggtggttatgccttatattttggaatggagggagtaacaagtactctcactctctctcaagataaatttatctttaatcccttccatacatatcaattaagaaaaatactaaaataccctcacattatcaaatcctaatacaattatccttcactttctctactcccaatatatctgtcccttgcttttacaaacactaatacattgattattcaaagataaacttatttttttaaaaaaagtaaaaataatcatataaacttattttaagaacaaaaaagggtaaaaatgatcatgttttagtaataggatgaatatatatagcatttggaaatcgagaaaatattaaagacgccaaataataagaacggagtgattaatctcgctaagagcaagtacaatacacttttttaaaaaaaaattatttttgtcctctttcaaaataaacctaattttaagtaattattgtattggagtttataaatttgggaacaaatatattagaaatagataaaatgaaaacaattattctaggatttgataaaattaagatattatactctctttttttttcttttatactgatatactactagttcgtgggatgggcaaataaataaataaaattatttaggaaccgacgtactgcccactagaaccaattgttgccgctgttgtgcctagctgcactctgtctgcatcagccaccaacccctcattggcatcagagatcagattcagagtcacacagtatttgtactcgccatcaggcccatcaacagcaccatgccagattgttaattactcacgcacgaattcctaggccatatactagtacacatctccaagcccgtgatggccaagcagacagcagattaagaaacagagaactcatctgatttgtgggtttggttggtagtaagttgttggttagggcctccctgacagacagcgttccaatcagtttggtgatcacatttttttctcatcagagcttttggttttgcaaccaatggcccctcttggcgatacagcatctgatgcttaatcttctttaataaatgatccttcctcattgtggttcaacacgcactgtaacaactgtagtgttatttgacattttcatccctaacctagttagtatttttgtaaatatttctcaatatctgcaatatattcgcccttgtgaatatgtccatcagagttgagacctcctaacttcccctttgaaacacaggcgttttacaaacagtttatacttcgtaagtgatataaatcttttctatgattgcgaaaagtaaaccagatatggctcgaaaaatggttgccatttttttgaatgatactttttcctaaatcatagagaatattaagggtataactgcaaacacaaaaaaatgtaggaaagtgccccactaaggccaagagcccaccaaaaaatttttttcttcaatttgcaacctgcactaccaaccttttctgcatcttgcttatatttttgccaaaaaaaaagaaaaaaaaaagagagaaaggagccaccaaacccagaacccgcagagaaaagaagagagagagagagagatcagaggagagagagagacagacagagtgcggcgccgaggaggagaggagcaataatccaattccaatccattcctccgcgacctcgtcgtccgatcatggccatggccgcctccaggttgctgtgggcttcccgcgccgcctcctacctcaagatctccactttccccagggccttctccaccggtatctctctctctctcttcttcttctctttcggtttcttgttttgcgtatgtatttttcgtattctgtggtctgtatattcgtgggatcacgcgtggttggtggtggaatggcgtgatctcgttgcctgttcctcgcaaagattggattttgggggcaaggatcactgttcatcttatcttcttttattttgggttcagttggtggtttaggctgtgaatccgtctgcgtgaatgggaaatttggttggtctgatttgatctcttttcggcgaaatgtttcatcttttttttttgaaaaaggaatcttgtgtgattgttcctgctcttggtaacagcgtgtgcatggcaggtttatgtttctgcatttggatatgtgaatgttagcacactgatttctgaaattcagattagcctattgtatgtgttgatgaggaaggcaaagttttttttttagcctaatttctttctttgtcctgtttattcgaagtgttaggacgtttgacaccaacatatgaagcatctcaggaagatgcttttagtagctattaggagaaagctacctaccgaccaataattggcaatattgttatccaatatgaaaatgttacaataccacggttgtttgtttatgaatttaaaacttgtgttgctaaaatggtgtgccacaatcacatatttacagatctgaattaggcacaccaaggaaatgaattaagggaaagtcttattatagcagactttggttttaaaactttggtagtaggaaatgaaaaccatatggtaaaatatttatgcaacttaagaagtgacaaatagtcaattgttaatttgcctggccaagaggctttggtttctaacaagcattggacaaatggtcataggaaaatacacctaattttcagtttataaattggcttctaggggggggccattaattccagttgttctggaaatttcgtatgctttctgtggaaaccttgtttcctcactgccaattcagtattttacacatctgatgaagttgtgcatattgcttgttttctatttttttcagtgctgaaggatctgaagtatgctgacactcatgaatgggttaaggttgagggtgattcggcaaccgttggaattacagaccatgcccaggttgatctattcatacgttatatcacattcattgcttcattctgtacatacgcataatataagcattccatttcttaaacattacagggttccaatatatgttatcatgttcagtacatgtagcaaggactagcagtgctaaagttgatcatgtgttgtttttttttcttttttttgcttccagcaccatttgggtgatgttgtgtatgtggagcttccagaagttggcagcagtgtatcccagggaaagaactttggtgctgttgaaagtgtgaaggcaaccagcgatatctactctccagtatctggagaggtggttgcagtgaacgatggactaggcgatgaacctggattggtaacttttaattgcgtaatagatcattgtgagtagattgaacacttctatgaactgtgttttttttttttttgcataggttaatacaagtccatacgagagtgggtggatcatcaaggtcaaggttagtgattcaggtgagctcaattcattgatggatgacgcgaaatactcgaaattctgcgaggaagaagatagcaagcattgaacaaataccagtgacttgtgatctgcaaagaatgcgccttgacccttttgtcaatgcttgtgatgtgctatcgagcacttatctttaccaccggctgctcctgaaatcagcaccgatcaacacatgaataaattagtgttggcattgcctcttccacaaagagttgcaaacttcgaacctgtaaatgacatgagtttcgttatttctttgtagtatcgcgtgatttcatcttcaattgtagctctgccgcctctgctccgtttatttctgaaacgtgtgcttcgtttacttctgaatcgtgtgttcttggtgtctacgagcctgcattatgctgaggaattggggatgattggtagtagacgaatagctaaatataaattggggatgcttgattgcttgagaatcgtcaatatttcagaattaggaaaaaaaaactcatcccagattatggccttacttttcctagatcctagatagtctgcaattctacagctctgttcttagttcttacattatcagtatttacattcaggtgatgagaaagaataggctacttggaggattccctaatcacatagcaagttcatatcacaattcacatatccttctgtcatagaacatggacgccaaaattatcaaatgacacaaatggatgtgtaaaatcaccacgagaataacaacatatgggacaaaaacagtagatacttttatcactataagtatatgtcaaacttaagtgatggtcagcaacattagtgaacagtgatacagaactaatatatatgaatttagatacaaaaacctaggcgatgaagataaatactacccttagcctgacagaacaatgtcctcaacaaaatacagaaggcctcaggttgcatcacactttgatgttccacttgtgtgctgaccgtggaccacgagtgatcccctcataatattgggatggaagctttcctttgttccaagttttcacaaacttctcgaacagatcacgagcagactccgaagaaagatcagagaaaaatttgcctttttcttccttcaaccaggttgcgaactcattgttctttgcgaaatagtcatctttggatatttctttgaaatcctgtttcagtaaaacaaaagaacaatgataagcatggtctcaaggagaaaggaaatggagagctcaaagggtgcagtatgccattatgtatgttctcaacagtttaatacttccccaaaattgttgttagtctcaaaaatataaatggcatacatgatacaactcctgtccacctgtccagatacagataagccattctggttcttgtgaactgtgaccttaaacaagtacctgacttggtatcactaattttcatcacagacacacaaaaggaaataacctacaaactgatatcactaattcaattcgatggcaacagcaaaaaaaaaaaaagcttttcctttatattcagtcttcagagacaaaatacattctggcaagcttcagcaaaatttcattgttcaggaaaacaaaaggggctcctactcaggctgggtaagatggctacagaacatataccagcccggcgaaaaaaaatggtcgtaagaaatctgcgataatctatccctgattcacgcactgaagaattaactgaactagggacgttctccagtttggttctacttgtaaagaaaaaccaacctcgttccagtaccatagttatacgaaggctcaagcttgtagaacaattcatatatgaaaaaatgtggcctaaatagcctattcagatagcttaactgctaatatgcaaaatcatttgattgatgatgcccagtagattcatagcatcattcagacttagagaactcacatcatccttgtgctttcgcttgctcttctccttctccttggaatgcttctcctttgaatccctctctgtcaaaatcacacacacacacacactgaattactgacatacatcaaagctaatatagcaggtacgagtgtatcctcagcataatttgcacacttccagaatagttgagcatgatttcaagtaagaacaatataactgttttagaacaagaaatcaacaagtgccactgccaagccgtgaaggcaaaagatgaaccctagttccctacctttgtctttgcccctgtcgccatgcttcttcttcttcctcctgcgcctctcctcctcctcctcctcctcggcttgttcgtctcggctgctcctcctgctctccttcttgtccctcctcttcttccgctccctctcctcctcctcccctgaaccaccaaacgcaccaagaagattggcaaaatcaacacgcggagaccagatacgccgatgcctcgagagggggggaatggatagggggcctttgagcacctgacgagggtgacgagcgccgcttcctcgacttgccctcgccgcccatcgtcgccgccgccgccgccggggagaagaatcgaagagggggttagctcaggtgaggtctcgggacgggtttagttggtattacagatgagtccgagggctcatatgcaaaattgtcagaaggctttcgggcgcggtcgatccaagccgttcacgtctcatccgacgttggggagagagtacagcaatacgaagcactcacgctctacctaggcaaatcgtgtggttaacatcaagtttatggttttgcgtaaatttcaccctggaacacattttattactgaaattttcttttgtaccacactttcatcgatttttttttattttggatcaaatgttaatagtcttaccattgttatactctagaccacaccgactctcttatcaagtatacgaatgatttcgattataccagttactacttgtcattgaactcaaaatatgttgtacgaagtgagtgctccctttgtccaatgatattataatcatgaacggattagacctatcctaaattgtaatattttgagatgggggaaatacttagaacatgcatctatgtcctctttgcgaatattaaaacatattatttattcctcacattaaaaaaacgttttaaaaaatttcccacttgtattatttaaacaacttttcaaagctatttgtcaagtttattttttaaaatatttaatttatcattataattaaatagataattcgtaccactaatatgtccaataatctaagtactggtactagttaattaattaggtagtaacaggtaatctgcgtcataatttatagttcaaccataattaacaatctacagaaatggcattaatcctcaagtaaattaattaagctttgtcgttgtgttacatcctaaaaacctcaatgatctctctgctaattaaccatgcaaatgcatggagaccttaatatccaactccagttcagtagttcacacaccaacaaatcaaaaggtacttagcagctgtactagttaactaggtagaaaagcttgattattctgatgtgctaattagacacacacacacacacacacacacacacacacacacacacacacatatatatatatatatatgtccagaacgatgaacaattgaacaacacagcaacccaactcgatcgtctatcatcagctgatcatgcatcttcatggtctccaagttactcctagctcccagaatcgacaatgccatcatgtgcttaattagcaagcaatcatctagatctctgcagaatgatatcaatgcatgattaattcgcagctgtgttgcgatgaattatactccctccgtttcacaatgtaagttattctagcatttcctacatttatattgatatatatatgtattcattaatatcaatatgaatatgaaaaatactagaatgacttatattataaaacggatgaagtacataaactagtagataaaatcattgcgatatatatattcacatcacacacctgatgagagtatcaggatgtgccatgtatgctttgcttcgtttgttcttaccacagctgcaggccgtggccggcggcggcggcatggaagctgctgctgctgcagccggggtcctgcaggttgggctgcgtcggctgcagccggaacccggcggcggcggcggcgtcgacggcgtgcagcggcggggtgagctgcagcgcggtgctcgacgactcctcgccgtagtacgccggcgccgccgtcagcatcgacagcaccggcgccatctccaccatcgccttcacgtcgccgccgcccaccgccgcctgatgatggttctcgttgatctgaattcatatatagtttcatgtacaagaatcaaccaaacaccataattaatgtacatatatgtgcttcaagaatcaaaacattttaatgaattcttgattactgattaactaactatacgtataccatgcggcacaggaagctgttctggtcttccaggatgtgctcctgttcatcaatttcatgcatagaattgaatcaatcattttttttttcatcatcatacagcaaagtatttggtgtttcatgatcagtttagtagtgcaaattaattaccttgcgacgaaggttgtccagctgctggttcaggagctgatgctgcaacaagcaagaattaatgtgaaacaactattttttatttttttaacgaatcggcacttagatacacctatttcattgaatataacaaaataaaaaacttacgaaagcaaagctttacagaaaagaggaaaaaactatgggatcaattaatccctaaaccctaaacttaccatttaccattgaatcagagactgatcattctaaattaactctgaagaatgattcattcatcaaatactatcttcttaatcaattactagctctatttcatattacaagtcattttaattttttttcttttaagtttgattaaatttatagaaaaaaatagcaacacatgtaataccaaattaattttattaaatctatcactgaatacattttgataatgtttgtttttgaaatactaatatattttttataaacttgattaaacttaaataaatttgtaaaaaaaattaaaacgacttataatatgatatggaggaagtaattacctttctcgcacggactttggtgacggagaattcgagctgctgctcgagatcgttgatgtcggcgagcgtgaggttggagaggtcgtcgccggtgaacctcctgatgccaccgtccagcttctccatctcgttcctcatccgagtcatctccacaaatatttgctatatatatgtgcacattaattatatttgatcagtgcatttgaaagaaaatttcatttcaactgctggcagatagatcgatatatattctgatattgatcagacattgtgttgctgattgtaaaattaatgtatacctgatcgtggttgatctcctcgaaatgagtgttggtgacggtctggtaatgctcgatgagttccctcaaactatatattgtcaaacattgaaacaagtaccttgattagttgtgagttaattaatactttgataagttcatgtatctaattggaatggtgcatgtgtaattcttttgcgcattcaaaaaagaaatgacaatctctgatgtacaaatcagatggtataaattaattttgtagctagaattttctcttggtgatgtatatacttacagagagtatattattttagatcaaaatgaaacaaacgaaaatttcttaactaataacaggaatgaacaggggatcggaagaaagaacttcacatgaatattcacatattaattaactataatatgctgcagaacagtataaaatcatgtgagaaacgtctggggatcttccggctagctccacaaagtggtggactagacaaccaaggttcgaaacctcacctcttctaattatttaatattaggtcattctcttatattcgcatctttttttaagtataaaaacatgcataacataagataagatatggtcgtactgtcgtacacttgttcaaattatattccctgttgatatacatcttttagtttgattaaattagccacatatgaaatagttttttggggaaatccacctaaaaaacccagctcgatcctagaaatcattagaaagagggaaataaggattaattaactagttgactataaattcaggatcaagttgcaaatctacatacatatatgttgctcagagatgtaaaagacaagtgcgtaatcaagtcacaagagacactagggcatatagatcattgcttatgtatgcctttgatcatgatttaattttgtaatagattcttggctcttcgaaaatatatcaaaggaaactgcagatgcatacatatacactgaaaatagttaaaatgaaggtaggaaaaactcgatcgatcaggagttcaggacaagaaaaatagttcagatgaagaataaatgcaaggcatccatccattatatgaacagatcaaatgatcataattaaacactcttgcccaaagaaaacaaagggtagaaactgcatgagttagttaattttctctgaaaaacaaaataaaggccgagagaaacttagccgaaaacttaatctcttggttgacaaaaaacaagaaattaattaacccatcaaatcaagcactaaaaagagaacaagagacactaagctggagaaaggaaagattgaacagcatctgataatataagagaacaaaacaagaaccgtacctgcaggtagggctgcagtactcgaacatcttgccggtgctggagaagatgacgacgccgacgcgggcgtcgcagagcacggcgagctcgttcgccttcttcagtagccctccccgcctcttcgagaatgtcacctgcctgttcgtcgcgttctcgatcctcttgatctcgatcttgccgcgccccatgcctgctataccttcctgatcgagtttaatttaatttctgtgttcttttgtttctccttcttctgcacaagaggaaactgaagaagaagaagaagaagaagaagaacagaaatggccaagttatgaacatatcgatacatggacgaattttgttaaaatcaacataaggcatgggtgctcaaattggatttccccccacagctatgtaaagggtgcaatcagaagtagaaaaaatttcatgtagagaagagaacaactagtagctagagatgtaaaaactctttgctgcgaaaggatgaagaactagctagaaaaggtgtccttttttttttcttgaattactcatgaacagggtagatagatagggcaggagtagtaatgtgctatgtacataccttgtgaagtgctaagcttgcttcaaaggctaaggcaggaggtgcagaaggagagacatatataggagagagagcttgtagtaatgtgcaacacacaatgctttctctctgtcacacactctcacactactactcctgcaaatcaaatcagtgtactactccaaatcaaatcaaaagtagatggagggagtagtaaatatccagaaagcaacaaactacatttttaactgtaactaatatgctagctagtctagttttacatttacccctgcatcagtgtgtaattaggatcagatagtgagtcaaagcaagaaacggatgcagacataagcatgacttcatgatgatgatgatcagatcagtgtgcatatccatgtgtgtacttgcagcatgcaatgatgatgcactagcatatactctctggtcgatctctgcacaaatacacgagcctagcttgtgacacaaaacacacactgcaacagtgcatatatcacgcacacaaaagttcagagatatcagtgtatgtagctcatgcaatataatgcaacagtattactcatcagagcacagtgcagctatatatacatgggcatggtataaaatcatgaacactacatgcaattgcgaggaaggtgtatgtagctatagcaactctctgcatgcccctcacaaggcaccatggaaagcaacatgtgtgtggacttgtaaccaccctctgacagtgtgggcccacccggtttcctcctccttgccgatcttggcagctaggtttgttaggttggccatggccatgaggagctctccagggacagggtacacttgctgcttatggcaacagagccaagaaaaccctagctcccttgtttgttgctagctagctaagagagagagagagagagagagagagagagagaggtatatgtgcagctagcatattgatcactatggttgcttgcttgccttgatgggggactgccactgcacattgtaccacatggggtggagggggggtggactgcacccctcatttgggaaggaagaaataaatttggcagagattttgatctctctccatgatggcttggctaattatatagtagagagctagggttccctatgtgatcaagttccgcgagattccgtgtttctcctttacagtaagtttagttttacggttttgctagctagccgtcgacagttttggaggctgaaaacttttgattttctggccgtgcgatccacgccatgattcgtgcgagatttggaaaaaaaaatctgcgcgagaattaaggtgtgtccttgcaagggcttgaacctaggatatccatcccacaagccgtgcgtgctagccacttagatctgttgcatgtttttaaaaaattaattgagttacatgttagttatactccagttgcaccctactataactgcattgtgtaattgcattgtaactacgttatcatctctatataatttagatataaagttacatatattattttaatacttatatacgagttacattatagttatagtaaaattatattacaattatactatagttagatttgaaagttttttccttaaaaaacttgcaacagttttctagttagtccctagttttattacgcacatgcaagtgggttttttaatatgaattcagtgagatcggggatatgttattggttttcatctctttgaacgtgtattaggaggcacattcgctggtgtgtgtgagcgtcatggtgcatgtgcgtctatcgtgtaaccaggaaaaaaataattttaattttattaagtattcttaagaactaatgatatctaagttattatgcattttatttgctttcagtcagtcagagggtcattggctgttaattgttggttgaccttctgtttgtccaaatcaatacataatttttgggtggacaatttagtatagaagtccatacgataggggcaaaaatcaataaagaagatcattcagtaacttattatatatcctgaggaatattcagtctagctagctacctcgatctgaatttgacgaatcagtaatgctaaagtaacaacgcattcatgatcatgttgaaatgttaatggagagctggtggcatatattcggagcatatatacatatatatgcatatagcagcccttttttttggtgaggacatgtagcaaatatataatgaccatatataagcacacaatataaacaaatatgtactgtagacaagaatacaaaaaaaaacttaggctcagaactgtgtaagcatgctagttagcttttagaaaatcttacattaaccaaaagtaaatgggcattcttacccacatatatatgatcagcattttcaggctacttgttgcatgaacatccaaacaatcttaatttgcacatatatttgtacatatatttttcatctcatccactgtctgcaactgttgcatatgtagaaagcgaggacttccatttatgaaacactgattgtgaaaggaaacggcctctttgcatcaagttctgtggctttcctttgtcgatgaagcttggtttcagtcccagattctttctcatatccaccaaatgtgcaaattcagagagatcacacgctttacatcgtctgattgatcgactgccggttcagattgagacatacacaaattacacgaaattctatatcactgtatatttccaaagtaatccatccaaatatgcatggttgatttctcatccaaactgtctgcacatatacaaacgcgtgcaattgagttgatccactgcagcaaattcaggtaactcaggagatcagtaaaagattggaagaattaattatcacttgccaacactaatgaaattctgatcaacttgatgggctaacttttgttcagagttggcagaaatctgaacatcattaattagatgacatttgccacgtagttgtgtgaaatcagatggcaacagaaatggaaaaaggttatgttgaggaagcttagcaagaaatcttttgccatagatgttcctgatgagttgtaaccaccaccactttacagcaatgacaattattgatgtgccaactgccaaagtattcaagaaagatcagcttgtagtatatattgttttcaggggtgatttaatttatgtgatgagaaagtaattaaacaaattacttacaatacttgatagtaatcataaatggagtccgaatagtggatccaccaaactcaaaataattaatcagctttagtcagctaggaaacagattcaactatataagtacatactttggacccctcttctgaagctgtaacctgttgattatcatgaaggcaagatgtgaattcatatacacatggtctgtgcgtatgaattcacatcttgtctttgtctgactgatagctacagcctgatacttgcagcagtacatgattacacattacatctactaccattgaggaaagggagagaatatgagtgactcatctttcctaactcacacaaaacaaggactcaaggatgacacacaaactagtagtactattcatttggtattctgttgtgtgcttgtgccttgtgacatatgcatttaataatacccaactctaccattaaaggaaaaagaaaatgttgttttccagtatgatacatggacttatgtaacttgtgcaaggaaacccacctcatctcagtcgatttttccatccatccgatagatcaagatccaatggtccaggtcaatcaaaccattcaatacaaataccaatttctaacacccacctctcttctactccccagctgccgctgccatgcatccacaccttctgcttcaacaggtgactcctccaacgatgctagacgccgatgagccctccgccgaccaccgctcaccattgattctacctaagctttgcgaggtgcccccgccccatccacgtcctcgtcctccgactctaccatccgccaccacctaaccagttggacgagattcgtccaccttgttctcctttttcttagttggatcctgccacgggatctaccataaccgtccaccgctacctaaccactcgaccgagatccccctaacctataccctcccccttcgtcttcaatggctcccatcattagatacgccaccactactacccccccccccctctttgtacccacggctccgattgcaccaccgccgcctcgtcgccttctcaccaccacccaccattgggccacacctccccggccttcctctaagccggggaactcccttctcttcctcatcctactgtgacctccaactgtgaattatattctaactggttggggttgttgtagccagttaacagagttcatcaaggtcattgaagatggaggagaagctcaccgaagcacggtaacaaagtagatccgaaagccagaaatctgtaagatttggaattctattttctattgaatgtaggttagcagttctgtagacaacattttcaagcacgaatgatatggcaactggtctatatatacatagtaaattaatgaagtgtgaaaacttgttttgtgcttaagaacagaatctaaatttgacctgaagaagataaacttttatgaacagctaacgcggtgatgaatttgagagtagggaaacgagctagctagagaatgaaacttcatacaggatacgttgtggacatggatcgattaggatatatccatcacaaagaaagcaaccatctgctcttccatgcttcagcagcagcagtcctgaattcctgatgctttgcacatcgatcagcctcagctttggcccttggggactgccaaatcgagtgcaagatttttgtaaagcaggaggtatgatggccaatgaaagctattacccacgatcccaaacatcaagcgaacataataagattacgctttggttgtatgcatcgatcctagttatgcagaggccacgattgttctcaccgcagttatatcaccttgatataatcgattagttcaataaaaactttcatcatctaaaactaattaataagagtacgcacacatgatcctaataattttgaagttgcttaaaaaaatagcggtctaatattatctagttctggtcaaaactaacgagggttcgtgaatgggggagtaattcatttgtcgttacaaactcaatataagaaaatagggatggtacatactagctggtattcccttgttattttattgtgtactgatatcttgtagtctgaccatttagtactaatatgggacacatactggattgaaggaaagaaattgttttccactatatttgccccctcttaaccagtaaataggattggacgaggctcggacaaacaaagcgcatttgcactaaccttatcccctcctcgtgccaaccttatccccttcccatatgatgtacggaagctcctcgtacccaaaggtgtccatggtgaggtcgaagtccaccaccgcaccgcacatgaactcccacagtagcactgcctcggtcacctgtagcggcggctccacctaggacaccctcttcgactggacgatggcctagacctcattgaggccatcatcagtttttccggtcacttggagcaagcaccgccgggaaggtaaccccctcaacgagccaccgttctgggatggtggcctcttggacaaagctcctcaccggcgtcatgtcccaaggctaggttcgattaaatccgctgtcaattaacccgccagcgccagacgtcgtcgcaccaccgcgggttcctgaccctaccccatgctcaatgtcaactacggcacaacgaggttcgagcgtggcatccccttctccttttttttgttttggctcacgagctaaataagctggctctggctcaagctagcacacaagccgagccaagtgtttagcgcgttagcatagcaagctgagccaatccaattcgttatcctaatgagcccggatgaactgagttgactcgatatccatccctacattgatatttgaaatgaatcaatgcctgcatataccagcaagcttaaatctggtccctattaatcaaccctatcatatctattattcctagtttaattgggtatgatttggctagctattgtacatatacaatcagttattaatggcattatttatttgtgcatatcttggtcacctatatatgtgtatatatagaaaatgttgattacaccataaagataggccttttattatttgcaatcataacttttttccaaattattaagaaatcgaatagtgtgtttcaaaaaagaaaaggggggccatagcagctataaaaagccatgccaacccaatcagatagccatcaccttcacagccaggattagcctagctaacagcacccctgccgcagcctcccttttgcaattcgccgtcaattcatacgtaaagcagctatagccatgcataggatggtgaagctactctgcacgctgctgctggccctttctctcacggcccactattcgggtaaatttctcgtcgtcccaaaataactccatttcttttctcttatccaagttcatatctagaaataaaatgaagtacttgtacgatcgatggaggtagtactgtttatatatcgatttatatgacgaagatcgtcttttctttttgattatatagaatacgcacatgtgaaaacttaataagttttgatttgatctgaatttgcagatatgtcgatgaaggtgtcggccgattgtcagagcgtcaacgtacccggcccctgttctcccacaacgtgcgatgataactgcaagtcgcaaataggtgctggggctgttggcgagtgtacgtccgggggatgccaatgcaccttttgtactctccctcctccaaagaagaactgaataattaattatgatgatgatgcatcatggtctgtgatgtatcatttaatcctagcataataaaattatacgaaattgtgtcgacgatatatgtggatgtcttttggttcgagcgacgtttaatttggtgcatctcttacttgaagattcttgtttcgtggaattagagttgtactaaatatttttgagatctcgaataatacagaaggatgttgccgctccgtttctgaaaattatggcccgtttggtatacagctcctacactccgagattcttgtttcgtggagctgaagctgtaccaactgtagctgtcatatccactatattaatcataatttaattcgctttattttcttcttctgctgagattttttattgattagattttgccatatttgcaagtaattaattttttattttttatttttttttgcgaggacaagtaattaattatttgagcgtatcttggttacctatgtatagaatatgctaattacaccataaagctaggccttgttatttgcattaattctatatcctttcgaaagaaaccgcatatatgtttttccagaaagaaaaacctagcgtcaactatgcaagagtatatatgtgtctataaaagtcacatctgtcgttcatcctcacagtaacagctatccctcgcggtctactgttggggtaaaattcactactcccatattataagtcgtttattttttttaagtcaaacttcttttagttgaatgaaatttattaaaaaaatcaaacgatttataatatgaaacagaaggggtttcatttttattgcacataagatacgtagtgtaaacttaaaataagcttcgatatgatctgaatgtagtagctaggtgtgtcgatggaggagttggccgatggagcaaccccaaaggacttacgcaaaaccatcaccatatatatccggtctgtgttttccgaagttaagtcgtgccttgtttacagcaacaagcaagttgatgcagcttctaccagcgggatgcctatatacctactgtctctaaactttaaagagaataaaatattttctttgtctcaatataagtaaaatctagtacaaatataacatatattaaaactatgaatctaaacaattttatagttctataatatattacatctgtattggattacacttatattaggacggagggagtagctacgttagataccatgcatgtacaatggatccactaattaattagttcttgctaccagcacattacccatgttcaagggctccacaaagaaaaattagaggaattttgaaggatttgattcgtatggaaaaaatattcatgtgtggttctttggaacaatagagaataactctcctaaaatttataggaatttcggagaaattcatggttttctcttccagtaacataaagtttgtgtcatccaaacagtaattttgaaattttatatgttttaagttcctataggaattcaattaatgggcatgacgctttactcatgcattttttatgtttctatgttctcacaatcctgtactctgaaaagtcctaatctacctaaaactgtggtaataaaaatgccccatttgggttggagcttcagacatatgataaggtgtgtagcaagaaatcttatgcttctgatacgtaacttgatggctatcatataaaacggagtcgaacttgtagatccaccaaactcaaaaccatccgcttgcttgcctgctagcagctaggcacaaattcaggcattcagctacaagtacctggactgtagataccaaatgaagtgcgttttgtgcttatggactgtactacaatctaaatttatcctgaagaagacgagcatttatgaacagtaaacccagaaatttgagagttcagtgaacaagctagagaatttgcccaaagtttatacaggatatgactatcgatgcaagggtacttgtcccacccactttcatccaaagtcaatacacaggcagttaactttcacacatacaaataggaataggattcaacagaaagaaaccaaccatctgttttttccatgcttcagcagcagcagtcctgatgctttgcacatcagcctctgctttgatgactgccaaatcagggaggcaagattcttgcaaagcaggaggcatgatgactgataaatgaggcaacagactgatgcatgacatgaacaaacactcaattcatacaagggtctccacatgccagcacttttgagtattggattagaaactgatgaaaggtaaggtacagttactacattagttgcaaatcacctaccaaatcacaatcttttttttttctactgctgccatagcagagcagaactaacattaggaaagcctaagacctaatcagattacccgtttcagccaacaatcatgggaatagttttgacaagagcactgagttttagaggccctaagttcacaggacaatgtatatcaatgtcacaacttcactgtatcatctttagctactttctggcagagagtgctgctcttcaggggcctcttcctgttgctcttgaggctgctgccacacatacgtcaccgggtgaccttgctgtccaccgtacatcattcctgatccaggcccctgctgcgctggcacgtagtaatatggatatgtgtctgctgcgccccccacattaggcggtaggccaaccctcggaagcccaagcccttcttctttcatttcatccctgggaactatgtccaccaagaagtcatagatatcagtcctggtgatggcagctgcaatgtcattcttctgcaaggtccggcgcttgttctcctccgtgtgcatccacgacctcaatgttaactctaatatgaatacctcgcatgcctttgcgaagacaacgggggcttctgccgagatcatccggacatcctcatcagccttcattatcttctttatccttgcgagtggcaagctgtggttcttgaagtcggttgtttgctcaatctcttccatttggttagcccagaactcacggagttgctgctgttgctgttgctgcagctgctgatgaaattgctgggcttgttggtagactagctggtgctgagcactgagttgagctggattagtggggaatggtgctgatggctgtgagccaggaggaacaacagcaggagctccaggaaccatggcttgaggtggatatgcagcagcaggaggaggatatgcttgtgacccaccagtggcaacacccatcacaggctgaggctgtgaggatggttccatgtcagctcttgtccgtccaaagccaaaggccctgtcgttgtgggaaacagttgcaagtattgatcagttgatcttttgtatagattaacgagaaagatcatgataggttctaaatttgtattttgtcaaatacaatacacatgagtgagaataccttggtataagaatggaactcactgcttttcctttacaaaattgtatctgacatacaaacttgcatgcagggaaaaaaatgattgaaggaacaaaggcaacttgattgcgacttttgttgcttatagtacaattaatgagcaacttgagtgctgcggttccatgtagcttgctgttgcactttaagcacaactcatgatctcaatactttcatctctattggttcattaagcattctaaacagaaagagacttccattgaatgtggaatagaattacagatgcataactaccagtatatgtgatagaacatgtgcaagctaaacagaaagtagaaccttccattaaaatcatccctatgatttgtgatgggatggtaaattaccttttgtactcctactatccatattgtgcaagtgggtagttgcatgaacattcaagccctgccattatcggtcaaactggttacggacaagtgaatttgtgggctgctattacaaaccaacatggataagtatgcatcatacagagtttgaagcttctcatgcatgtacagcataaatcacatgtcttgatgttttccggtagaagcaggtcccaaagataacccacaaaaggtagctatgcccccatggctccagttatgacttattagtctcccagaatgatggcatttgtgtccagagggcacagatcggctagttccaagccaattgcacaggttttagctcattgactgacaaatcaatgtttggataactgagatgggagatgggaaaatacggaatgaattgtatttctagtcaaggctttttttctcccctctactgttggatatccaacactccaaggatggcctggatttggtgtagttacccagctgcagttgcagctgtcatggcagggcagttcataccatggctatgtgttcctcctaatttactcgcagcatctcatctacttacatcaaaccgaattaagtctatgacacccagatgccaaatctcataaatatttttttccatgtcaaccagaagtgtgtgtaaaagaagactacaacattcaagcaagtaggaaaaaaaatgcacacttaaatatgtaagaaatgttaaaaatgatccgctatgtcattattaactttgaacaacatatcaagaagccaagtgatccaaattgccatcttactctctgtttgacacaccatcagtactaaaataaagtgctgtcaggttaagcttaaggttggggtgcaactaccttaattggattctttgaagaatatgtcaatcttgtagttccaggaggtccacacatttgggacaaacaaggaaagttggcacgtatcatgtcacgtgacatttgaacacagaaaaaggcaaatttagatacattccaaaactcagactcattaaatgcatgggaccaatcacgtctttttttagggaaaaaaaaagagaagagagcagcgtcctaacacatacgcgatgtgggtgatcatgtaattatgatccatcactaagagaaaatatcactccaagagaaaatcatcatatcacttcatgaaaaaacaatgcaacgaatggtaggaaattaggagtgccctgttttgacagaacatctagacagcaaatcatgagatcctaacagtatgaaaacaacaccaaaataaacaaatttagatgtggcatcagaacagtactcttgcatctaggaagtttgcactcgtggcagaactacgttaagcgcgcgtcagcaatccatcatcactgaccatggtaatggtttcctacgagttgacccactgttcttacaagaagatgcaggtgcggacctaacacggggcaaggccagggtggtcatccatccacaccgtgcttcttgctagtcacgcaggcgaggaactccagctcgcactgcagatcggaaacagaggagagtacgatcgcgatggtgaaggagggcatcttggttatctcacttctttgaagctccatttcactagttagtaagctccattcccaaatcaaagagaacatcaaacctaattctcctctacagcagctccttccaaggctccggcgcggcgccaccacaccagcaactacaaaccctccgcctctccggcgagctcatgaactccggcaaacaagctagggttagaattctgggcagtggcaaggcggccatgacacgggaccaactcaacactcatgaacacaaatttaccaagacgagaccgcacgtctctccacacatatagcaaactaaaaatccaaactagaactaagcaggatcaagcaatcgaaacgaagccgacgactaatcgaaacctaaccatatgctgccaggatcagctccacagccctagaaacagaggcgatgattcctccctcagctacgagccgagagagaattcccccccccccaagctagcaacacccaacccacgcatgcagccaacaatccaaacgggatcacccacggaattgggaacagagagatcgaggaaaggtggcgggaggcggggcttaccgagagacgacgcccggatctcccgcgccggcgggagcgggagcggcggcggcggagagcgctccctccggcgaagggccgcgccgcccacctccctctcgtggagccctcggcgtcggcggcggagagagagagagagagggagacgcggtcgcccttgggtcagaaggacgcgaggaggaggaggagaagagtcagcgcgaggaagacgaggagagaggcagcggcggccgcgggcgggggtggtgggctcggtgggccggaggtttctctatgtgggctccaggcctggtaaaattccgcgttgtttctgttggagaaaaaagtctaatttgcctcccttcgttatagcccatttcgcaccgtaaaaatttctaacgcgcaaccaactctaaactcacctcacgctctacacaatcacatccattcacaaagcctctgatgggttatcttatcagccgtagctcaattttgaaatttctaatttgattctacattttttttatcttagcctatttttaatattagattttaaatcaagaataacacaaatataaattttatatctgtaatttattttgttggctttgttcatttttctatgccttatcagctataagtcaaaacgatcaaaacaaaacaaaagctggagacttcgcaaaggatataatgaatctcgatgctaatgtgaataaataggatatggatttttttaaaaaaaaaacattatggacacaagtgctcatgtacaattgcgcgcagagagattactgtatttctagtattataaaaaattaaaaagtactgatatacgtacaatccgattatacaactcatatatagctagaaacttgcaaccatagttcaatctttaacacatttccccgcaaaaaaaacacacacacacattcatatgcactacaatcagcatgcatgcacgggcatctcatctgagaagattgggaagatacgcaaaacgaggtaagtcattagcgcatgattaattgagtataaactattttaaaactcaaaaatggattaatatgatttttttaaacagatttcctatagaatttttttttaaaaaaaaacaccgcttagtagtttgggaagcgtgcgctcaatgtatctggaacgaacgcagccttcctcctctacccccgtaatttttgcagtggtggacagaaccagcagttacaattgtttgattttgagtggctaaggccttgtttagttcgtgaaaagaaaatttttaggtgtcacatcatatgtttgaccggatatcggaaggggttttcggacacgaataaaaaaattaaattcataactcgcctagaaaccgcgagacgaatcttttgaacctagttaaaccgtcattagcatatgtgggttactgtagtacttatggctaatcattgactaattatcctcaaaagatccgtctcgtgatttccatacaaaatgtgtaattagtttttgtttttatctatatatgactttttgagaaaaaaaattaggaactaaaccaagcctaaatatgtgaaccctatagcctgtgagttgtgagcctatcagggtttcccaaaacgccggggccagagttaccgcgctccggcggtaagcacggttaccgtgcggttaccgcggtaaccgtggaaaaccataaaaaaccgtgcaaaatttatcaaaaattcaaattattttttaaatttatttaaatttaaggaggttaccgcggtatttatattaccataccccgcggtaaacccgataactacggtaaccaccggtaacaagggaaaccctagagcctatacgttactaacccacgtaaaaaaaaaagatagtacgtccgatgagcttcttccgtggtgacccactgaacctggtgcgtcaaccgctagctagctgagctctcactcaactggagagaaaatggtgatttcagggtgaagcaataattgaaattaaatttgaaaatatactttttattttttttcttagaaataccctatatgcaaattttgacacaaatatactgatggtttctctgaaccgttgtgcgaaagtgacgatgtgaacggtctcgcgcaacaagtctgcgagagtatttcaaaaattaaatgattaattaattataatcagttattaattatcttaattagtctcgcacggtctcactcattctccacgtgacaccataatatcgacatcataatatcaatggtatatttgtgccaataaaattacatctagtatatttctgagaaataaaaaataaatggtatatttttttaaatttaattcacaataattgtgttgctccactattcccttcgtccgaaaatattaaaactagaatcgaataggatattttctaatatgatgtatctagatatatgacatgtttgattggagggagtttttataatggattggaagtttaaagtgatgaggttattaactgttttgtttggttgggatacatagtaattttggtgggatggccggatgtggatggggaattgaggaaggaactacctcattttcaatacctgggtaggggtggtaattgggagataattccttatttattttgcctaaataaatcttaaccatctgtttttattaatgacccgatctctaaccaaacttcttatcgactttcaccacctctaccaaataagatattgggattaaaaattaaattttcatcttaatctcatcatcaatggatcatgtaaactcctaattctcttccctcgtgttgccaaacaagtcgatagagtttggtttcagaaacgttgtaataaacgtcacattcattcaatcctatgtgagcatacatctttgtccaccaaagctaggtaggcagttagcccatcacttatcgtgtctagtattcccttcgcatccatccacgattcatctatcgtcaccatccagctgatccagcgaacgcacgtatatattccccttctccatgccatacgcaatcttgatcaacatgttgatcaactaatcacttcaattacactctcagatagctgcttgggttccccaagatcggtgcacgatcgcaattaattaatcttaatcacatctgtacagtacacatccatccgacaaatgaacggatcttcgcttgcaggagatagatagatcgatcgatgtcgtgctattatttctcttccaatattcacaatttcatccttcccttcgatctcatctcatttgcagccatggctgggagatgcatggcgatcgagaagaaacaaaagaagaagctcaaaatcatcaagaaaaagcgaaaagaaaaatctaatgggtggccgtggctggagcagtgcggccggcggcgaggctgctcgggtgggcgcgagcggcggcggcggcggcggcggggaggacgaagcgggaggagaaggtgtagctgtagtagagctgcgcggcgtcggagtcgtcgtccagcccgccggcgacgtcgacgccgccgcggtcgaagttgcgcgcgtagctgagcgggtcgtactggcaccggccaccgcggagccggctcgacgccggcgccggacgcgccgcgcacagcgccgcctgacgccggaggcgccgcaccagcctgcccagaccgcagccgcaccgccgcgccaccaccgccgccgccgccaccgacgacggcggctggccgccgacgccacctcgcccatccgccattgccggcttgccgctgagcggtggcagagtggagtagtgagagagtgagagtgtgtgctggctggctttcttggtaggtgaggtgaggtgaggtgagatgtgtttatttataggtccaaggttaagtcaaataaaatgtgtgtctgtgagactgtgaccatattaaaaccatacaaaattacaaatcatgatttcaaagatgtccaaagatactggtgtcctagtactccactagtttgaacaagtgccaaatttggttctatttgtaagggctgtttagttcgcgaaaagaaaattttagggtgccacattggacgtttgaccgaatgttaaaaggggtttttggacacgaataaaaaaactaatttcataactcacctggaaaccgcgagacgaattttttgaccctaattaatccgtcattagcgcatgtggattactgtaacacttatggctaatcatggactaattagactcaaaagattcgtctcgcgatttccgtcctaactgtgtaattagctttttaaaaaaattctatatttaatgtttcatatatgtgtctaaagattcgatgtgatgtttttggaaaaaactttttgggaactaaacaggccctaaattgaaacaaattcagcacacaaactatgtgggtttatgcctggactggggcactaggtagcagtaactcggagtaatggtaagcaggtcatcgtccgtagtacgttgctaaacgctggaaactccatgcagattggtttcttggttccagaaaagtcgaaaacggtgggcagcgtgtggtccaacagcaataccatggattagtgccgctcatgcttcggagaaaaatgagtaactgacacgtggacccatgatggatggtgagcctcagcagtcaggaccttctccttccgttttttttttttaaaaaaaactctaacgataagatacatgacgttgagtttcactagttaggaatttactgtgtccacgcacaagcggcgcatgcagccacggcggacgccacagtcgtcatgggccgctgcttgtcgcgccgcgccaccgatgcgatgagatccccccatcacgcaccgccgtggcagcctcaccgtgcccacccacgcatctgatcccatctcgcaaaccgtttttgtttttttgtttttccccttttttgagagagaaataaaactgcgtaaagtttttcaagaaatttccaggcagacaacggtttcatcctctgctactgcgacgtcacctttgaaagaacaaattcttctccaacaaaaatcgacccaaatttgcagcagtggccatgcatacacatccacgggaggacagacagtgtgcatgtgaatatgctgtgatctaatgggcaggcaatgggaggacccacgttgcacacattcttccctaaccaagatgccctgtctctctggattatagtagtactaatcacactcccctgaattctgcgaatggattggactgatgagctgagcttgttgatgagaagacattgcttaaagcgaacggctccatgattcctaaccagtgtagttgtagtactagaaaagttggaaaaagttcatgcactttagggtttaatccatccatcctggaaggcaactgccgacaaggttgccctggagcccatcatctccagtagtacgccgatgagcaatcgatctgatgatccccatttgctttggatcctcagcagctggtggttcatgctacagttctgcttgcttgtcaagatcgagctcacatgctcgcactgtttggtttggtgattgtcactgatttgaactggtacaaagttaatggttaacttaactcaggcagtgagatgagatacaactggggaaagtgtctactagttgcaggtattctaaataagaatcacatgagatcagcaagtttggaagaaatttttttttatggtaaactggcaggaataatcatcagatggagtcaaacatcgcaatttggcatgggatcaacagatttgtcggctacgattcaagctgccaccatttcttgctgcgtgatatataaatgactgtgaattcagtactgggggctctgcaatcctaacacgataacatggcactgttcagaactgcaacgtaacagtgatttttgggtcctgtttcaaaatctaagctgaaatcgcctatagctgacaaatctactccaaaaacatgtattggaccatgcctttctttagtaccaaattccagggctcatcataggaatgatataaaaaataaaaaaggggaccctaatttcatttgagatgtataatgagccataagcaatatgcctgaaaattttacattctctagtctgtaatgaagaactaacaatcctccatgaaacatttttcctaaaacagtagtcttatgtaattgaacctttttcctttttaattttgtttgagtcaattccttttgggtatctatatatcaaaagtgatttttataacataccggtatgcagaaaaaaaaaggccgttaatatatttagtacagaaaagcaaaatatatggacagaagaagaggagggcatagctctgtgagcacccagtggggatcaaccacagttgaaaactggaacacgagcagggtatcaaatgaccaaatatgtacaaatggaatccaagcaagcccgttgctagttagcgttgaatcctttgagtgggagcctgaaattttgcagaacagacgccattaatagttcactaatcatggatatacctccgccgtttcacaatgtaagactttctagcattgcccatatccatatagatgttaaggaatctagatatatatgtgtctctaaattcattaacacatatatgaatatggacaatgctagaaagtcttacattgtgaaacggagggagtagcatttttcttttgatattaatttatatagagtactgatgatacttttcaaatttaatgtgcagaaacaagagttagataaatacaaacaaacgagaaaccaccactgaatgttggtatagaacttatgagtaatgactgcaactggtgcccccagctcaactattccaagttgactcaaattaaagaaggcttagcttactacttgcgatcagaattatctggaaattaaaggtgcttttcttttgagaacccacaggaaatctgtgtgactgcgccatagtacttggaagaagagaaaaactgtggcagacaaacccagaccagcaaagaagaaaaaaattggggcatccaaaacaaaatcacatctacccttatgcttaactgcaagtgattaccttaaaatatataatactagatggactgccatatcatctcatatcaataaatgcatttttgcaataatacaatccaactgcattctctgacataaaatgaggagagtttatgcatcaatgtcaaaactcacatccaagtgactattaaagattccaaggtactccctccatcccaaaatataaggaattttgggtggatgggatgtattctagtactatgaatctgaacatacttcatatccagatttgtagtactaggatacgtcacatccaaccaaaatcccttatatttagggacacagagagtatggaataggtcaatctgtcggctagaattgcctatctgatgtgctactgctcaagtagtaacttatcccttatctataagaataaaaatcagcatgcactagtctgcacaaactgttaaaataaatattatgccaactagggagggactagctagacacactacacaaaaccatacattgtgggatgaagggtctcgtaagacaaccatatcagtaaaataacattttcatactatgcagtccttgctatgctcagacgtatttgaattgaatgagataatacaatgagaaacatgcacatcttgtaaatttgaggtagcaaaataggatgaaaattgtacttaggatcaaataaataccttcaccaaacaaagacataagggcacatcaggacaacttttacaaaatacaacagcttgcttgttccctgaaaaggtacaatcactcagttattttagtatagctatttcataagacatatagttacaaaaattagagtagttttaaagctaaactttaaaaacatgtcaaaattgcatttttgagtaagtttgaatatttgatgtcaatgctactaaaaatgttgatgagagctactcacacacttatgctctcattttttgattggtcagtaaggcccaccttataaacaaaaataccattttaagttaacagcaaggagaagcatacttctttggatcttggtatagtcttaaggcctccaggaatttgttccaaaatgggccagtctcctgaaggctaacgttttctggtcccccaaggtatgcctgaacaatgaactcgtgacttctttctctgaaagagagaagatagaatgtgtcagttttttttttcatttcgctagtacatttattcactatgctgaaaacatgttagcatttaatctcactaaccttccttcatattgtgacaaccatcccaagtaagctgcgccaaagtacattgatgtaaaaggattgtatagatcatctacggagctgacagtatacgccctatggccacaatctctgcaggaaaaagctaactgcaagtgaagataacttcatgaaaactataatattataaccgaccgagagtaactgcagtgtgtcttctgatagcctaagcagctaacttctcctatgcctatttgttttccagattaatcttctctagaatatgattgcctgacatctgaagtaacataaactagacaagtagtagaccaaaataaattatcatagtttaaatcaccatatgaatatgtatgaaggtatagtccaaacaatagttcagccatcctgaacagtgcattactctgtaagcattcataactagtaaaagggcaaaaggaactggtaaggtcctactaggattaagcaaatagctcaccaaaactgttagacaaaaagcaaagctttatagataattaaaacacaactgtaaacttaatttcatgcttgcctgtaaagccatgctgcagtagggtagtctattcccatcaagccagtacgagaacgaacaccatggacaaaacgcatactgcacacctcagcaagagcagctagggcttcctggcagatatgaatgagaatagagaatttactaaatatctcaagctttcttggaatgctaaaataagagtaaatactgttattgtaacatgcacccaaataggccaacaccatctttattcaccattttgaccaggacatatatactaacacaatctatggacatttgcataattttagaatatccacaaaatagagaaaatgctttgttgacaaaatatacaacaaatccattaactaatgcaatgatgttacatgaatcgacaaccaaaataagatgagttttatgtaaaaaaagaacaagatgagtatcagcactgatgtgatggataatcatgctaaagtactaaatgtatgacttagaaaagcaataccatgcaacaaagcaaataggttaagagccaaaagaatttcttcagtttgcctaaatgttggcctcatcacatatttaaaataagggagggccatgttataggtgatacagaaagcgatataaaacaacaaatttaatacataattagtatcattatacagatactatatgttcactgatttataaacaaaaaaacttactggtgttactccttttgagctcaaatgacgtgatatggttatttcagcaacagcctgagaaaaaaatttacaaccacgtaagtctgagatggatggaaattaagtattggtgaataaaataacaaatacatgaaacctgcaagacattttactggtgagcagatataggattattgtatcaaacaaggcatgagtctgggattgttccaaaaagaaggaatagctatggcaccaagtataagtaatgcttctgtgaacaatatttgtccatgtaatttgtatggcatgataggaaatgtatagcactgcagccacacctacaaactacaaagttgattttattacatgccatccacacgagcagttcacttgatcaaatcaaggatgcaattttaacagcacaagaatattaataagattatagtggtagctttacacaaaaacatatgtatgtcaacattttagcatggtaaaaaaaggtggcccgtatactgcaaatgcaaagtaactacaaaaaatttaaagaatcatcttttaccttcacctcaactcgagaaagataaggcctcctcttggagtcatgagaaaacctcacatttcctcgcctctcaccagattttgtccactccttaatcacatcgggctgactccacatcgcatccatatctacctctgataccttggaatcccaataaatcaactgtccttctgactcaaatgtgataacaagatgtcagcttgaatgttagaagcatatcaattctctggaatcaaaacaagaatcaacatcctaaaatcataacctagtatttgctaacatctcgacaaaccacaaaccttgaatagcagaaaattatttaaataaataaaaaggtaacacagtaaaatttaacctgtgctcgaggaattggctaggagattaggagttaaatcattaaaactttctggctgtctgcagacaaaatagcaagaagcagtttgtcagcaagttcagaactggaactaaagtaaaataaaataatagctcctctacaaacataacttttggatttcgatccattgaatatgtttctaaccctaacggaaaactcagaagagcttgaaattctgaatatatttgagaggccgagcaaatgatgcaaccatcaagaaacactcatgtttgaattaagaaatatcagtgttttaattaacttggtatttcgacaggtcaggtgagcatgaattacagtaaagaaagtcactaaacatattgctgtccatcatgtgtttaacctgccagcatagaaggtccacatagcacagctcaggggtcaggttcaggggttcaaacttgagatgaaaactactgttctttaaattatgtgacatgtcataagtaaaattttaggttttttacctcaaatcttcaatggccagttgttttgagaagttcaaaccaattttctccaacttaaaggtttgctaggcttccaaataacctcaatacctctaaaattggaccttggaggttcacaggtgctaagagaaacgaatttgtttagtgcttaaggcacacttttcacagaataagaaagttagaagctgaatatggaaataaattattaagggtgaaacctcatagacagcaaggcctccttcacataaagatagcgttgaaagatgggggaagttgatttgtgaacagccttctttttgcctcccttgtaagctctaacaacgaattcttcagttctttctctgaagtgtttttggcaagtaattatgtttggcagtagaagataaaatatgtcaaaggaaattaattgcaatggtcaagcataatctgacaatcaaaatacatacttatcgtcacatgagaatagccattttgcataagcagcaccaaagtagacattcacaaaaggccaatagagcaaattagcatcttcttcaatgtcataatacttgtaacccaattcccttgttaaaggtaaagaaaacaaatatttagtatgaaaacatagaagaaaagatagttactaaatctgggttatcaaggtttcatggtacctgccaagccattgagcaacttctattgtcacctgcattatgccagctttgatctccttagtctttcggtcataattatcgacaaagagtctccttccacttgcaatttctgcaagggcacctatcatatactgcatgagtgatgaaagtaaaaaataatgtttaatgtacttcagcagtgtctttgatacatatacaaatccaaatattgataagtcataaagcaaaagaagcaataccgggtctagctgtgacttgaaatgcttatgaacagtaattgcagccaccgcctgaagaatcaatgaatttagttttaagccaaaattgtacagataagtagataacaagtacagttttgaaaaagaaaataaagcaaaggacccttaatttgttattgtttccatagcttcgaaaatttgtttagatcagcgcagcagtaacaaagttgtcaacagtaatttagtcacttggataaatataggtaaaaactattatgttagactcttaactcacagcactgattgatttttgtcttgtttaaacttcggtgaatcaatttgctggcactagtataacctgcatttaacgccactacagcataggtacaaggaaattattgttcaaaagtaacaaccaagtataatataaactgctcaaaaaatagacacgatacgtacagaaatacagcttgcgaaaaaataaatacaatgatttacatgaactttggttttttttctttttagataatgacatgaactttggtttgattgccactaatgcaggttttagatgtcaagatacactggctacagctgatcactcaccatcatttcagtttgtgtgagatatgcctcaccatcaggatcccgtgacaggtgaaccttctgtcccggcccttccccagcatcaatccactctttacttacatgaggatcagcccacattaattgcatatcctctggatccaagcagtcatcccaatatttgaagcttatagccattttgtactaattagcaattgtatctgtcgatctacactgggagcaacaaatatgaaaattatatgcaataggataacttccttaaagcaaaaggaaatccaatgtgccaatctgcattttgttcagggttgacatagagggtgatggaattttgaacagttagaagccatcaaataattaggaatgggaacgttgccaaaacaaaaacaaaaaaagaaaagaagtgagcaaacaataagaatatgttctgattgcatcgtaatagatgcgaaaagcatccgcgcttctacaaccaactatgcattcaatttgagctcatagcaacaacatggagtaatcactgaaaagtgacagaaataattgcttcaatcacagttacaggataagtcaccccagaactgcatgctgaactcatcacccaaaaaagaagcaaacagggttcatgatcaaaccacaacacaaccaaaccaatcatcagagacgcatgaagcacatataaccggggcaattcaccccagaaacaaatcagcagaatcaactccagaggcactgtatacacaaccctctgaaatttctcaaccatgttacaccgaactattcatattacgaccgaattgacaaaaactacttccactccacaggcgcatgacaccttataaatcatgatcactgccttccaccgcaacgcacctcaaaatcacatgtatgcacaatcccacgacactaacaagtaccggaatcatgaaatcgaccatgggattggaggcagtaaacaaccgcatgcctgcatgatgaagcaacgcatacacaacccaaaaaaaaaaacgcagaatccgatagccacacaaattgaatggtcaccccaacccagcagcagcagcatcgccgcgtcacggaaccagatgcccacacaccaaaacaccatagcgtcatgcgcacgcctccgcgtccagcgagaccacccgcaacaaacaaacagcagccgcaaccgcattcgccgaaccaccacgagactagacgcgacgacgaacgccgtcgatcccatccatgaactccatgctccccatccaaaaaaaacaccaaaaatcatcgcctcgctcgctcgctcgctcgcgcgctggatcaccaaataaagcgcaaaaaaaatgaaaaaaaaaactgaggcgggatcggaacgggagctcaccggcgcgcgggattgggagacgattcggaggattggattcctctcgcgtcgacgggggatttggttttgggagggaatggcgggttggtgcgtgcgttggtggaatggggaattgaggagagagagagagggaagggaaggaggggagagagagagagagagagagagagagagaggcgcgtattgccgtttggtatacaacgagggtaggggtggcaggcgcgacagtttaaatgtcggggagcggggacacgtgtcaggtggttagggcgcaatgcagctggaatttttttcgcgagcaaattgcatactttggcttttttttttttttgcaaaatttgctgtaggacatctaaaaaacgctaatttgctataggacaccacaaaaaattggtaattagctgctggacacctgcagaattattttattatatccggagaaattggatagagaaacaatcattaaagacaagtttgcccttggctcaaatgagtccaaacgtgggccccacatgtaagctcaaatgtaagccccccctctctctccccacgcagcgccacgtcgaccagctggaacacgccattgcatacccacacgaggacggtgagacgccacattctccttcgaggcgtcccggtgacactcatcgtgctactgctaccgccgcagccgacctgcctccaccgcatctctctcgtcaacagtcggttccgccgcgtgctcactagccgccggttcctccaccatttcagcgacctccacatcagcgcgccaggggctcccctcgtcgggttcttccacaaccacaaccatggcgcctgggcgaacaaccgctccatccctatcggcatcaatgacaccggggactgccgtcggagccaccatcgcggcgccacgacgcgtaatcctgacggggtgttcgccttgggcgacgccgccgagtggcacgtcgtcggctcccgtggcgggcgcgtcctcctccttagccccacccagctccgcctcctcgtgctagagcccatgcttggtcgccgccagtacatcccggtgccaccggcgcccaagtacaggccgtcatacttcagcaacgcgcaacaccgttccaaccgaggtgcccgcactggcccgcgcctcgtcgcacgatcaccagcgctccctcgggctcgcttgaagagcagagagagaaagagagaaagaatgagatagagaagaataaggaagaaggagcagagaaggatagagaaaaaataaaaagaaaaaaattcgaagggtagaatcgtacttacacagttgtttctctctgcaatttctccggatataataaaataatctcgtgggtgtccagcagctaattaccagtttttggtggtgtcctatagcaaataagcgtttttgcagtgtctcccagctaattacacgtttttttgatgtcccatagcaaattttacaattttttttactattgttataacttaaactatgtatgtaaatggaccatgtatgtttaccaaaattctgccctacaggctacacctgttcttctacctccagttttttctcttctctagttctcttatgtttctatggagggtgaaagaaccaccgatgacagattggtagctaatcgagcatccaccggccaccattgccatgcgcttgagatgaaacttgaatctccccagcctatgttttcacttgagctaaaaaaataaaagaaacaaacaaaaaaaaccaattgctaggatagagggggacatgtggagctcgagctcaagcgatgcgtcaatgttggcaaaggttgagatggagcatggcgctgatcagtcgaactagagctcaagtgcaacatgaaagctagtaggactcaaggtggagcacatcaccgatggaggcaaaagatcaactgcggtgatggtgcctacggagctcaaggtggagtgcatcaactaagatgcttgtgctcaaggttgagcacggggcagaggtctaggttgagcgtggcaagcacactatctactagactctagctaaagacaacatcgacacttgtggcaaggttgaggtttcccgcacgcactacactagctagcctcagaactcgaggtcatcattgacggtgccactgatgatatgaagaggatagagcagagggagggagccgttggtcaaaggaaagaggagggggatccagattccaggacagagccatataaggcaagagtctcacgtatggttctcttgagaagagcgtaataccaccaccgatgagagaggggagggagggagctggagaaaaaaacaagtccaaattgaaacaatttgtcaaaataggtggtccaaactagaaaggtttggttacccttgatccaacacgtaagtgtggtaaaaaaattcatatcaatccaataggcaatttactgttatttctcatacatatgagcatgcatatccacaattaatccttctattcacatgtttaaaagaagacgaccaatgataaatatgtgatttttttactgtatttatattttgtataggaagatcatacatatgttcaaaagaaaatcataatgttgtgaccttactaaattactattttatatttaatacatgggtggtagggtttgataatggataccagttccgctctcatgtggctttgtttattgccatttcagatacgtaatttcgaaactctgcaatttcacagcattattgtaatatatctaatacaaaatatactagctcctatgagataagaattttgataaacttcatggattctttgcaaggtacaaacaattttgtttcatttcagtccaactttatctgtgcgtttttcacattggaattcttctccccatgtttcaaaatagaagagctgtgctattgtcttctgacctagcaccacatatgcaaaatatgaaaccatgcaaggatgcattcactattcgatgataaacaactcaggttgtgatattacttacactgtactatgaagatagcatttgtatggcgtggtacgttaaaaaatcggagggagtaaaattgttttctctcgtggcagagtaaatttgaattttgcaccgctcaaacatcaaaagcatggtcctgttcggaccagaatggtacggctctgatgctctggcacaaatcatgttcttctcgtgtaatccctccgtcctggggatttttgatattttacttttactgtttgactacccatcttattaaaaaaaattatgcaaatataaaaaccaaaaaagttaggctcaaagtactttggataataaagtaaataaaaaaataaataataattccaaaatttttattatcaaccaacaaatcagccagccaaaaggcagcttgtcattacaacttgatcgattacttataaataagctgtatcatactattatgtgatgaaaaaaaatgattaattaaggatcctttcgttcaaatggatccacaggggtttattcgccagaaaaacatcgaggtgagattaattcaaaaggtggttcacggcaaaaaactgtgaaacatgtaaaacttcaccaaaaaaaaaaagattctccataatgagttgataagatcttacattgcttgtccttttcaattagacatgttgacatggcagtaggaaaaaaaacatttacatttattttgaacagtgtatggtttgtcattcatttgggaagcacccgtttggccagttcttttcttttcctctccttttcatttcggtccttttctgctttggttggttcgcctcttatatccttttttttctttaattaatttcttaaagattataaaagctcaaatctatggtagaaaacagaatgcccgaactttaaacaaacaccaaatacactcattcgtcaacgatgtaatggccatcatagacgaattagcatttagcaaccagactattgacaatcccttcttctccttctccaccttcccattagccaacaaaaaattttaaacaaagtgaatgaaaacgagaatctttcttccatttctcaatttaaaaacaaaaacaataatttaatgacaggagaggtgaggttgggggtccacaaccccagagagtcgggagggcgagagatccgattcggtgcggggtaggcgacccacctacccattctagtaccctctctccctcccattttaaacgtagctataaattttcgtgtttaattttaatcgttcattttattttataactaataattttatatagttattagatgataaaatatgaatattactttaagtgtgactcataattctattaaataattttttaaatataacagacaattaaaattagacacgaaaactcatagctgcgttttttaaatggacagagggagtattctacagtacaacattttccttttataaaaaggagacgagacgagtcgctcgcctcgccgccaccttccccttccccccctccgccgcctcctccgccgcgaaacgaaaggcgagctctctctctctctctctccgcggcgcggtcaaaaccctagcgcgcgaggaggccccccccatggcgcagcagctctccgcccccttccgcgccgccgcggccgccggatcccgcgcctccgccgccgccgccgatcccgccaaggtatcgccctcccttccattcctcctgtgctccctctccctcaccttcttccccaccccccctccggaattttccggtttgttccgcgtcggggttcgattggcagagggttgggacgtcttcgttcgttgtgtgactagttgtgttgctgatactgcgcctagatttcgtcttaagcttggtttccgtgaatctgggaaccttgggttggggggggggggggcaaatgctggggttcgtttcttgtttatgtgcgttctccctggttgcttcgtactataatctgttcatttctgtgctggagtatggaggttacttttatacatactagtggagaatcatgtacccaggcgctttattgttatcagcaaaaagttctgtactgttatcaacatagttgattcttggtcaaagaaatcctattcacactcttcaattaagatgttaatactattcactctcttcaattatgtgttgctcatagttagtttgttggatttttagttttttagtagtagaaagatgtccctcctgttgatgcgatttgcctgctatggaacaggtgttacgcttgagaagcgctggctcagctcagttcacctccatcgcagcttcctcttcattgtaactgcctgcttctaatgcctatttcttcctcttcgttgtaagagcgcttttttgatctgattatgttttaacgcatctaaataatttttttaactcaagtgctaggaacattgagccgctgagagcgatagctactcaggcaccccctgccgtcccacgtaagtgtctggtttcccaaacaaatgtgtaataatagaattgtgcaggcagcagcatttgattattcctttttgtttctgtctgtagaatattcgagtggcgagaagacaaaggttggcatcaatggtgagttgcttctgtttattctaggaactagtccattaattttaatgggatatattaatctgtttattctaggaacctagtccattaaaaaaattgctataattttaatgggatatattaatctgtgctggccaatgcattttgtcttgcatgcgttttttcttttctttttttgcaaatatatgatatcaattgcaactgaatgtgttagttcgagttccatgtctttaggttttccaaaagcaatttttagtgctcagttaggtatatgctacagcaactgaatcacccatggcttgttggcagaagtagtttacagtttattgtaccatacatcaaaagtaggcgaaataatttattgctatttgtttgtaatgcttgtcttatttttttggtatcatagggtttgggcgaattgggaggttggtcctgcgtattgcaaccagtagagatgatattgaagttgttgctgtcaatgatcctttcattgatgctaaatacatggtaagaaaatagttcaaattatttgcctacctcccatatttcataccttggttgcttcatttaatcaatgaacattatattttcaattttggggggatgaagttttgcttgcatttgctacactgcattagcttatatgatgccatgttacgttcttttaggtttgtaagtgttataaaccttgacgaaaagattggccttttctcagcttaagctaaattaagattgatgcagataatattttatttgaaatcattgaaaaacctacttaatgtgcattcaccttaagttacttaaatatgctatgcagtccattgtgctacatttcaatttgctagttatatattggcacagtttcttggttcttccatataatcacacgaaactgcatccctaccttatgtgttcggttcaatgaccataatagtccatttcaatgttttactcctaatgcaacataattcctgtcactgtgggagtaccaacccatccttccatgcggatgcaacatttggttgtgccttttctttctgtagataatctctttcttttttccaggcctacatgttcaagtatgactccactcatggtccatttaaaggctccattaaggttgtggatgattcaaccctggagatcaatggaaagaaagtcacaatcactagcaaaaggtaatatcaagtccacttagggactagtacatgattacatagaatgtcacaattatttgttatctaagtattgtgtttgatgattattagtaaaaaaaaaccctcttgaaacattgctagtaaatttggatctcacaattattgaggtattgcatcactgtgttcccatgccatcatggattcaacctaaaattctttggatcactggaaaaataattattgtagcctaacgtataatctggtcttttgtcgtatcactgcttacttgtatagtcgaatatattacaatgtgcagccttgtgaaataaagaaaagtaaagtgtctttacgactctaaccatatctggagtatggagtgattgactgaacatgctatacggatttataattgagtaccttttagtcctagctcctaaagtaactcagtattgttgtgtacgttgtacatttggggtacttcacaatcctttcttcaccgtgcccctgctctcgatacacaattatgtttctgtgactacattaatttctgttagttcttgcatttgcacctaagaatttgcccccttcttttccagagatccagcagatattccttggggtaactttggagctgagtatgttgttgaatcttcaggtgtttttacaacaactgaaaaggcatcggcacatttgaaggtttgtacaccatttctatacattgccatctaactgagaaatggcaagcttttatattggataaaatggtgatgtttttatgccttgtttgtagggcggtgctaagaaagttgtgatatctgctccatcagcagatgctccaatgtttgtcgttggagtaaatgagaagagctatgatcctaaaatgaatgttgtttctaacgcaagttgtactaccaactgtcttgctcctcttgccaaggtaacttatctatttctaatcctgttactattttcccattttaatcataacaaacaatttgctcttgtgatttttcatattttcgtccatccaatggagctaattgatattccatgggtatgcaggttgtccatgaggaatttggcattgttgagggtctcatgacaactgttcatgccacaacaggttttctttcccttatgaattttgtcattgtcaaggatggagactgccaatttttcagtctcctcatatcatgttgttcattagtcataacagacttgctttcctatattcagccacccagaagactgtcgatggcccttcaatgaaagattggagaggagggcgtggtgctgctcaaaacataattcctagctccactggtgcagccaaggtacgatgaaccaaaaatctaccttgcttttctagatttctgttttggctgactgttttgattccttattaggctgttgggaaagtcctccctgagctaaatggaaagctcactggtatggccttccgagttccaacaccaaatgtgtctgttgtcgacttgacctgccggattgaaaaaagtgcatcctatgacgatgtgaaagcagccatcaagtatgtaggactatcatttgtccatgcacattatctgctgtttctgtttggtcaattgttttaagtcttaaaatgcttgagttggtatacagtagccttcaataatttgaacgtgaacagaataatacttgtgttcacaaatgaattgcaaaagtaacatatcccttgttacgtcttttgactgtgctagaaactgcggtcatgcacttgtaccgtctgaagattctgtgatgtgcctgtatgtaacattgtgaatcttttatcagatttactcataagctgtgtgtttcagggcagcatcagagggtgcactgaaaggtattctaggttacacagatgaggatgtggtttccaatgacttcgttggtgatgcaaggtaagtacttctagatgtaccgatgtaaattgtgttgtgctcaaaagggagtggttgacataactgcccctttctgcatatcaggtcaagcatctttgatgccaaggctggtattggactgagctcttccttcatgaagcttgtgtcatggtatgacaacgagtggggctacaggtgagtgtctatatttccattaaggggcttaactcttcatctttttttccaattgttctattgtcctaatgattctgttccattctttgtttcagcaaccgtgtgttggatctgattgcccacatggctcttgtcaacgccaagcactgatttgttgaaaatcctcctccgatagtatctagctaggaaaggctgcaattttgacggtctctttctgttgtcttggaataagatgtaaacttggaaacaaagcaaaaaaagaatggacattgatgtccatgacattgtttgtagcaggcggtgaaatttactctgtatcgacctgggcaagcggaactgttgagtgaaccatatgtcggcaacctgattgattcattgagtccaatgctatgccattctatatttactttaaacatgcttgtttcatgccagaaatgttcaacagacaattggcaatttacctcaactccagaatctgcagaattttgtttcaattcagcggcttgttgagagtaacagcagagaattatgtaggctgttaccaagagggaaagtttccggctattcaccttcaataaaatcagcagcagcagcgatcgaggagaagccgaaggtgtgccagagaagccgtgccagaggagccgtacgtgttggtggccataagtcggaagcaaggctatacaattgcatagttccagtagcttcataattactgcttttcattgaccatggttcccattcgttattctctctatccatcccagttttatatcatatttgtaaatggagccgagactaaagcaacaaaatctccttccttcttaaaattaaatctcatcggtcaaggtacgcaaacgtgcagacatgtaacgatatcatttactcctatacacgtaaatgaataagcatgcagcgatgtcatttactcatatacaaataaacgattagatgatgattaaaaagaccttaaaaattttagacaatgatcaaattggaatggaggaagcacttcataacatatctcattgtcgcttccaatttttcatcatgtaagtacgtctcatgcgatttttttttgaaaataatacgattttaatggaaaattgtaaaaatataggtcggttagacgaaatcgcaagagtagcagcctgtcgaacaaccggggttcgacattgaacaaccacagtttaactgtggcagttcgacaggtgattaaaaaacttcaaaaaataaaaacaaaacattgtagcagcactgtagcgcactgtagccacgaccagtcgaactttgaaagttggatatgtctgcagcgatactattcacgcgaccctatcaaactttgccagttctacatgttctcgctgattccggtagcagtacttttttgttttttttatcaactaccctgtcgaactgcacccagttcgacaggtgcatgttgaactacacctgtcgaaccacggttgttcgacagggtgctaatcatgcgatttcgtctaatcgatatatttttgcgatttccattacaatcgtattatttttttaaaaaaattcgtctcatgctattgacacctcgtataatcgtatacatgagacttgagagtactaaacaagcaaattcacctcaatgctatctaaaaaaaatgaaaatagttagcaacgttacattttgtggcccacttcattgtaaagatgagcccgacccctctatatttggctcaaccgttaatctatcatcaatcattaaattttctctttaatgccaatttaaacgattctattattgactatactatccatgcatgttaaacgcctatttattttctctctaatgccaatttaaacgattctattattggctatactatccatgcatgttcaacgcatccttttttttcctagttaattgtatcgtcctatggttaatggatagcaaaccataaattctttccaatgttacacattttatccatatacccattttcaaaaaagaattcacctttcttgtcctataaataggcatgatatcctacccttgtgcttagaaaaaaaaaactacccaccctttgggttctgcacctaatagcaactggtatctaaggtttcgtgtttcgccatggcttgcaaggttgcctccatatttgcatccatcctaatattgtcggtcctcgtcatgtcttgcggtaatatcatagtatacgtacactctttttgcgtattttatgaagcattgggggctagtaattaactaatttctcacatatatatacttctcacaaacaaaaacttctcttaattttggcttgaacagatgcagctggtttatcctgcccaactgtaagagcgccgaatccgacctgcctgagccctcaaatttgtgctaatcagtgtgtagcagctggttatttgattggattctgtgagttttatggtagtcgattgggtgactgcgtgtgcaccaaatgcacaaatgctgtgcaagccggccgtcctcctactattgctcctactcctgcagtgagaaggttgattctgtgagaaaaatacatggcatcatcaatttgtgatggatacaccatgggaataaattaacttgtgtgttgacgattgctgaatttgttgaatcgagttgttttcttgaccaagtgttgaatcgagttgttgagaattaagaaaataccaactatatatatggtgaaattctaccttatttggtgaaattctaccttattgtgtccggcgaaattctaccttgttatagaggaaaaacctgagtatttttcgccccttaggccttgttcggttaatccctgtgagggagggattggagaggatttattccacacctactgcggtgtggaattattccccctcaatcccctccaatccaatcctcttcaatcccctttaaactgaacaatgtcttagtaggggtgttctatgttttaccacccgtacatgatatgtgggtcatgatcaacctatagtggcaatgactaagtttcaactaccagtgaaccgcaaatcctagagttcgactaatagtgggcgtgttcggctggcagtgttgtggctacaaccgtgtatcgaacgcaccctgtaaagcaggaaatttctaaaaagaaaatactgtgcatattatgtttgtttatgattttagtacgatccatcgctgcgctgcccatgtggaaagaggaatccaattttgcgttgaaccgaaacttgcagccgttaataaacgttaggagagaaacatttgatcatacaaccatcataaacagaaatcacgtataatcggtgctcaatcctcaaatcccccgtacaactgatgtttttcctcttgtgtatttacgattttacatcaaggtgatgctgaagttagcactggaaaatttggataagttgatatctgatttttttcccctggagaaatctgtattctgatgaggattgcataatgggcagtcagtgcagtaaaaaggggaaaactttactgtccaacatgattcagctgcccaatttcttaagaaaaatgggatatacaagtgtaattggcttgatcatttttttttaaaaaagcgatttcttcactacaagaataggcagggcacacatatataggttctcatcttgcaaaaaataaataaacaaataaatttcgactactacctattacgtcttgagctcttgaaggactttttaagtcctgaacttttttttaatacgtaaggagcgcatttttttatcaagaaggaataaatgtacggaaatgctgcgtgctgggcgtccaacggcagaagaaaaaatcgggcgcccacgcctcccaccgttgctactttaaatagttttaaaatgatttttctcctaaactaattatccaatttacgatccgatcacgccgttgtattcgttgcaattaaatctttacaacaagactacacatgattatatttcgataaaaaaatattttagcttttttattgatatgttttgaatgttacatatgatctttttgatgtttcgaccagtagttttacggtgtttcagttagtgtactcgcgatgtttcactatgtacagatcaaatgttgcatcaaatgttgcagtggattttgatattatggaacgcgccgttgcaacaaatcacgcgcatattatggaaaccctctattaagggaatttggtttattttttattctacacaaaatgtttcatctagtgcactcacaatgtttcactatgtatagatctaatgttgcagtgaattgaaatattccattgcaacaaatcacccacatattttggaaaccctctattaatggaattcgttttattttttgttccacacaaaatgtttcacctagtgtactcacaatgtttcactatgtatagatctaatgttgcagtgaactgaaatattttttcactatttgttgaaacattgtttttatataaggtgaaacaacacctgatttaaacgagtgagacattttcgatctacttagtgaaacaattccgatatacctggtggaaaatcgtgcaacatttaaaaataattcgataataagataattttttttcgtcggaatatatccatgtgtggtcttgttttgaagatttaattgcaacagatttaatggtgcaatcggatcatgatttggataagtaatttaagagaaaaatcagtttagagtaattttgcacgtaaatgttttggataatcatgttattctcgattttaacctccttctatcggccgcccgagccggagtcgcgtccataaatgtatgtacaaagcgggccaaaaagacaaagcaaaagggacgaggtacaagaggagaaccaagaaccaaaagcctaatctccaactaaattttgcgacccttctccactaacatgagctgccaaaacagggattgcagctctagctagctgccacagctccgtttcacccgccataacccttgcaacctccgctcaagttctgctcttctggctgaagactcgattgtttctttcttttcagatcgtccatgcaaccaacgtcgtgatggtgtcaaaacctcggcgatcgtccatacaaccaacgccacaatggtgtcaaaaccccggcgatattcctttaccatcttcttgcgacagagtcctgaacttcctaacctcgttctcgaagaaacgtgccttgtgttccttccacgccgttgaaaagctctggtgctatttttttttcttacttagattttttgtagataacttttgttaattagataccaaggagcagctgaacctgaacgaaagcaatttctgcttcagaggacctcgatgaagtaaaatggaacaaagtcacacatagcctaatcagggaatgcatgccaagtctcaaataagctggatcatcctgcagttagcaagacactaagatattaacacaatcctaaatgccattattagttagctgtgtggatatagagatcatatttctattcattattaaaaaaaataccattattagacacagggttaatacttaccccttatccacttatacatcttgatcaagatttttatcaaatcatcaatgccatccatttccaatcagtggctgatttcttacaaatagtcacccctgcagatcaaatcctgaaagtgcatctaggaccctaatgattttgatgattgattacaatgcgattagagaggactaacacttttattcaagcaaatgtgaaggttgttatgtcctcaacatgttgtaatgagatgcataccccatgaatgcgacatcacgatgcaatgcggcaatgatcaaatggtatattgtatcttttaccttacattgtgtcgtaggaatgtcgtactattaagagggataccacatgcatattattggtagaatactagtgctcaaaatgcttcatctttgtgtgagttgaaaaacctaagtcaaaatttcaatcccgagttgtttcacttgtcacaacacttacaccgggtttctttgcaagtttttcaacatctcttgaaggttttggaccatgttttatgttgggtttgatagcccacgaaactagctttccatagagtccaagatcttcgaaatcggagttcggagtaaaaagttattgcagttttactttagcaacatcagactatccgatttgaaatcagactatccgatgtatcggactatccgatttttcacagaacttcactctctatcttgatttgaaaaaaatcctatcgagtgagtttttctaagtatcggagtatccgatgtcggatcagatagtccgatgatacagagactccgaaatttcatagaacttgagtctctgtttgaggacaaagtttttgcttctaaaatatcagatactccgatttaacatcagatagtccgatgtctcgaaaagtccgaaatttcatggaacttcgttctctatttctcgttgccttggaggtttaaaatatcggactatccgatcttgtatcggactatccgacgtgggctgaaagattcccctccaacggccacatttttggggggtctataaataccccccacctaacccttttctagggttacccaacccatttcattctcattcactttgggttgagcttggtgctaaggtgctttggatctttgagctctttctccctctctcaaatccctccttgttctttgtgtggtggatcttggtggttgtggatttggtgtttgagggcctagtgtgtgtttcactcgatcttgagcactagggtttgaccaagagttgtgtggtgtttgttactcttggaggttgagtactcctagacggctaggtgtcactcccgagccaccgatctacgtgtggttggctgagagaagtttgtgaaggccggatctcacctccgcaaggaaaaagataccccttagtggaaggaggagtgcttagtgcaacctcttgaggaaagggttagcaaagacccggctcttagtgagctcctcaacggagagtagaatcccctcaaggatttgaactccgggaacaacttcatgaacttcatcattggtgatctcccttcatcctccttttagctttgcttaattgtgccgctatagatctagtcgctgtttgtgctttactcttgtttgtgtgatagatctacttgttgtgcttcattggtggatcggacagtctgatccaacatcagactatctgatattttcggatagtctgactgtggatcagactttccgaccttatttcagttttagcttctgcataaaattttaaattagcctattcacccccctctaggcctaattgaccctttcaaatccaaccaaatccaataactccatcccctaaaaaaaatccaataactccagagatttcagctttcaggcttttagccatggcttattgcagctgcaagctcacaccagcagcaatggtggcgtccatattattcctggccctcctcctcctctcccctccctgcagtaagtacacatgccaaaacaaacagcagcaaaaactgaattttgatttggtttacattcactctagtgtgttcatagggaagcataagtggtgtggtagtgaagtcatggatgcataactccacctataaatatttatatccgcgaatattacgctgttgacagaaaatacgaggcctgggagatctgcttaactccagtgcaggtccaaagctcgccttcgaatgtatgagcttgccagttgatttgatcctataatcaacaagaaatagagacaaagaattcgtggttaaatctataaatgatagctgatcggctaggtgccgatgacatatcatttatctttgagccgatatcatatatgaatcgatcggcggttataaatagatagtaaggaactaaatctattcgatcggctgtagatattaacgatatatagttcttatattaatatatacttaaatcaagtgattgggatagatcggtcaccatgccgagatagtataaatcacttagatcgaaatatatattaataacatgattatatatgtttatagcatagccgatcagatagatctagaatgtatcggctaatactccgatactactttatataaagatatcaaaacaaatataatataccaaacaaaagcttaatatacttaaatgcaataagatcctgacataaagggcggatttaacatgtcattgaagcatatagatcgaatatggttaaatcagataagatcggctgaaactccgatactaccctaatcggcaaccagaggacatgctagagattgatattctaagcacgacttaatagatcaaactcaactgatgcagcattaagtatgaaaagaagaacaatatctagacaatcaagccgctgggtgtttcataaagtcttctattaacagatgttagccgattataggttagatgacgatattgccaaagattatgtaggatatatgataacttgatgaattatatagacaagattagagtgtcataaagatggaagcactaatctcgagaacgcaagtcatcataacaagttttacctcttgttgaaaatcgaaaccgatgcagctcaacccgaaagcaagaactcgtcgaaacaaaactaaaacaaaaaggtggcgatgcgctgaaattgtattgaacatgtgtgttctttttttaaattacatagggctcgggttctatttatacccgagaattacaagatatgtccataccggacacggccactatctctaacaaactctaagatatcataagtctttgcggcagacttttgcccaaacatatctctaaggaagttacataaaacatcctaattaatagatacaattgccttctcaggactctatccatgtgcggcaatcatcttgaagcacctcaattcaacccaatatcatacaccaaatcatactgtcagaatcggacgcatcggctcacctagtccgacttagacccagccgatcctaatcgtagccgatctggacttcagccgattcttgctctgttctcggatcaatctccgccttcgactccaccttgatctaatctccttttccgatgctgatattaccaaatttggtcgttaacacatgccccccaagtccgggatatttgataatgttccgaatttgccgtgtaccgattctgagcaagtttcgcactctgccgtttttcaaccgttattctattgctttaaataccaaccattgccctcgagaaatctcatgccgtgacttccgttttcaccgctcaagcgaaaccattactctccggcgattcctccgacgcaaaagcgatcccctggcgatttcgcttttgatcagatctccgcctgcggtgatgtcgtcttccactatcccgtctactgcgccatcggccgagtatgctgaggtaagttctcaccggctagatcccttttcctcgcatgaaatcgatttcttcttttctcattatgttttctgcttcctgattcctttggatttgcagcacctttccaacctagttgcgattcccagcctatcgcacaaaaaccattattttcttggcccaatcgacaatcttgactccactgatttcatcattggtgaaaccaacagaatcccctttagactagccaaccctaacttgggtcactggaagaataccttcaagtcttggctatctcttgaaaagcctatccctgataagagctagaccacctggtaccaacgcatatcggctagtaagaaaacccactgggatgagattgggatcggccaagcgcttgctctcaccatagccaattctgctaaggatgaacctctgatggctgccgccacctatttctggtccaacaccatcaatgccttcttatttaatcaagggccgatgactccaactttgattgacatcatcatgattactggattagatgtaacttcatcggctaaccctataagtatgaacaccaagaaccaatttgacttcaagaccaaaagcataggagggtggtctggttatgtagcgacatacatgggcaaagggcctgtcactcctcgggagcacgtagctttcttgctaatgtggctagaaaagtttctcttctgtggatccagctgtggtcccacaaccaattggcaatttgtagccgaagccttaggttcaaagaaacaatttcccttgggcaaaatccttctcggctatctataccaaatgttgaacaatgcatcggctaagatagccgtcggctcaatagttggagcaggtggaccatggtggctactgcagacctggctaaacctggtagtcatgaaagttgtcaatcggccatctgtaacagaagctgaattcccaaggttggagccaattgtagaagacgatggagaagaacgcacccatcgcagatgcatgtcatatggagaatatgcatcgacaccagccgatgctggtgcaaaactatcggctgagctgctcaaagattggttctgcagcttttatgaaggcttccagaaacatgcccgggtttagtttctttatgaagacttagcagaccttgagctcccattagacttcagatttgaaaacatcaatcgtgaatgatatcaaacgtccagggaagtctttacagctgcaatcagcccatgcatcctacctgtcggtattcaccaaggaagaaatatccaagtctcctacgaattctatcaccctataagttcagctagacaacttggattaggccaactcccaatcggctttttctttgctgacaagatccaatgccgaggagaaatttcttcaactctaatgatggatcgactgcttaacctccaaggacctcccttaggcagtatcgacaatattgagttagcaggattcaggagcaggaactttgacagatggtggggaatggaaattgcatctatttcatcaatcggccacaatgtacatgtgtcacgtcccaaaacgactctaaaatatatcccttaaatgatgcatagaataattaaaatccgtgtgaaagcctccaacaattaaaatgtgcaaagttaaaagccaaataaggcttagaggatttttgtaaatttcctaaaagcctaaaatgcgtaaataaattttagtggaattttcagagcacaaataataattattaagaaataaacaaagttaaaatgattttataaaaagaaaaaccctaaaagtcccccttccctcccttgggccggcccggcccatctctcctccccccctctctctctctcctctccccgcggcccactcggcctctccccgcgcgcgcgccgctcacgggcgggcccgcccgccatcctcgctgacgggtggggcccacctgtcatccccttcctcccgccgctcccgttgcctcccccgcgccctagcgccgccaccgccgtgaatcccgccgcctcccgccgtccccgcgtgcaataaagtgggggggaatcactccccgtgatcccctctccctttccccctatttttccctctctctctctcgcattcaaacgggcggatttgcccccgcaaatctcgccggcgccattgatggcggccggacctcccacgccgattttcttcccctccggccgctctctcccccttccaaccctatttaaaccctccccgcgcctccctcgcccgtttccgccccttgccgcaccgtctccccaccggaatcgagctcgcgccgtcgccctctctctcctccgtcgccgacgacctccggccggccttctccgctcgccgggaccgtctcccgccccggcgtcgcctcctccggcttcgccgcaccgccgtcgaccccgtccaccccctcgccgagtccgccgaccgccggaacgccgtcgaccccgtcaacccgagccgcgccgccgcctccctccgctccggccgcctttttcgtcgtcgccgtcgacctagggtgagccgtggaccaccgcctcttttcccccttcccttctcctctctcggccgccgctccgccatgcctatggccgccgccggcgaccataggggtgcgggcgccgcctcctgccggccgcgccgagtggccgccgcgtggggcccggccgtcagccgcccgcgccctcgggtgcggctgacgcgtgggacccacggcgccggccagtgcgagcccgggtgcgcccggtccacgtggaccgtgaggctgccgcgtgggccccactcccgtggacctggtccgcgcgcctcctcccctcggctgacgcaataaaccctttttaaattaaaatttaaatacagaaattcgcaaatattcatttaaagagcatataaacttcaaatggccataacatggccatttgaactcggaattggaccgttcaagtctctaatttttccttaagaactcaagaacccatttttgtgctttgttcctgcttattatatggagtttattagagtaaaagcccttttattttccgttggtcgtgtagacgttgcagcttcggaagatccgctcttcgtggaggttgaagctgacgtttgggaaagtgagcaaggcaagtcacatcatccttgaacatattgaatcccagtttaaaaaattattttgatttaaattattgcattatcgctttatttaaattcccgcgttatcactgttttatctagccatgcttatttacctttgttatgaccttattattgttattgttattatttccttgttcaccctagaataaacaaaaccccaactagtggacactctactcatggtaccactagtatgattttaggtagatgcttcgctggttaattaggcaatattaggtggttttacaactctagactttgggaatactcttatcacctggacactatggaatggttggattattatggaattggactcacacctccccctctattcaaaaccctcaaaatggttttaggctgggctcggggtgcattgttttgatagtagcacctcggccatataaggaccgatcttcgggcctctgttgcaaagcactaccgtacttccacatgtctagtgggtaaggcttagtttgtggctcagtctggttataaacaaaagtacacggatggagatggatgaagtcgggagtcgatggacatctctagggcaaatgaaggctacacgagctgcggcccggtagtcgagatgtcatggcacagggccggtgtcctgctgttaggggttcaatcctgcctacctgtcccgggggttccggccgtaggtggggttgggtcggtactcttgtttatggctaggatgggttggaaactatgtcatgtcttccgtccgtataccgtggtggtatgtggcacgtggttacacgtgagaaagatgtgtcttgtgggtaaagatgtacacctctgatcagagtataacctattcgaatagccgcgccctcgtttatgggcaagccgagcaatgtacccaagttagtgttttaattcttaaaacctgcctaacagctaaaatgtggaatggttggcctgggttggcttgggacgagctgggacccagggtcgggttgccagttcggtctgaatcatcgtaggccttgggttaaggcaggttcgtgtgggttcacggccttggttaataatattgtatagctctaggaccgtgtttacaaagtagctttgagcaactaagtgacttttaatgctgtttactgcaaaccctaaccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgtcgtcaagcgcctgtggtcgtcgccctagtcttccgctgtttttcgtttgtcttcttgtgtgctgggccttcgccgcccatgtaataaattaattaattacgcttccacttgttaaactctgaattgtatcaatttttggtgtaccttgcctcctgggacaaggaataatgtacgcacgtaaggaacgcccgttgggttatttccggtcgtgacaacatgacagatctattccctgacgtcataccccgggtaaactttgtcatcactaaatttcataacggttagccgattcattacttgactaatcttttgttcctgttctgtagacaacagtgtcctcccctccacatcagagcaatagtggtaggaacattgaatatgccccaggtctgattcctaatggaggcggattgtccccctctatcatcggctatcatgcccccaaggtctcaaccctcctccaaggtgccatcagggaaccaaccgatgtaaccaagaaaagaaaaactagatcatcggctgtgaacaccttgactctagctccaaagaaaaaggccaagtctaagaaaaccaagccaaccgacgacctgcctgctttggatccatccattgaacaagctctggatgaagaagatattgaggatgatgttgatcaggctgcagccgaagtaagtgatactaaaaaaacaccatcggcttcgcctaagcagataccttcaactccttctgcccccactcacttcttcagagtaaaacatctttccttgcaaaccctattataatcattatttttcagccgactactcataggttttgtagttgcaaaagaagaaaactgctataaagaagaaatcagcagcaccaattctcaaaccagcttcaccagtaagacactctcaattttactagttgattttagccgattttgtctaacacttgtctttttacagcctcctcctccttgttctcctgtacaacaatcaccgagtgaccgaactccatcggccgtggggagtcatcatattgtggaagaagaacaaccggctgctcctgctatcccagtaagttttcctttgatgcaagaatttagatcgactatattgacttagctctcaaactttctgaacttatacctgtaggttctaaccgatctcttttcttttgatatcaaagattatcttgatgaggcagaagaagatacttcaagcaaagctctagttcccttatctaacgatgcaaagaaaacacttgaagatatctcgcgtcggctagaggcctcttctctggatagcttagtggtcgactgtggatcgattaggacacgattgcacgaagttcaagctctaattcctgaagaactagccgatgtcttaactccagccgcttatcttgagcaacatcaatttaaactagcaaaagccaagctaagattagccgaacaccgtgagcgcaaggagattgaagccacaatccaagtcaatcggcagcttgtgcatgaagaaaaagtcaaactcgatcagctatccgaaggtctgatcaaatccaatatcgatcggcttgaagcccgcaagattgatctctttgcacagcttgaagaatgcaatgctgaattggatatggagcacaaaaagctagccgatctcccaaaatctgtcgaagagcaaaaagcaaggctcaaatcggctatcaagaatgttgctgacctaaccaagtccctgaagatcatttctggaactgatgctcaagatgcccaagccattgaagaagtggaacaaattaggaaaagagctatttcggctatccagcagtacttgtctcaataacttttgtgtaataggacttaaaaattcttgtaatcggctaagataccttaataccctgctgttttaacaatccttcgtgccgattaacataagttctaattttcactttcatttttggtatatatgtgccccccaattttataatgtcaacagcattgataaaattagaaaaacaactaatggcgatataacaatatcggccgttatatatcggcaaaccataaccgattacaattggaaaaacgactaagggcgatataacaatatcggccatctcaagacgatgtaaaacacatcggctgtcatgcatcagcaacactagtcgatcatgcgtcaacccaaacacttgggtaatacttcttcaagtatttgccattgagcgctcatccataaacctcaccatcaagcccttgcaacatatatgcccctttagacacaaccttatagatttgaaacggtccttcccaatttggtgaccacttgccgaacttgttatcccgagttccaatcggtaaaatcaacttccatacaagttcaccttccgaaaaatccttaggcactactttcttgttatagtgcctagcaactcgttccttatctttggtaaccttagtaagggctcgtaaacgcgattgaaccaagtcctccctctcatcggccataagattataatactcatcggctgtcaaaccatcttgcaattctatccttctagagccgattctaacttcccatggcaaaacagcttcatgtccataaacaagcttataaggaggaacttgaattgatccatgacaagccatctgataagaccacaatgcttcggccaaccggttatgccattgccgaggataatcagaaatcttccgcttaattaatttgatcaagctcttgttagatgcctcagcctgcccattagcttgtgcataatatggtgaagaattcaataatttgatacccacgctatcggcaaactgaacaaactcatctgacacgaagattgaaccttgatcagttgtaatagtttgaggaataccaaatcggtaaattatatgttcttgaacaaattgaattgcatccccagaatcaactttcttcaaaggaatggcctccacctacttggtaaaataatcagtcgccaccaatataaacttatgccctttacttgatggtgggtttatcataccgatcatatcaattccccaacctctaaatggccatggtttaataataggattcatagctgacgccggcgctcgttgaattgccccaaacttctgacaatcttgacaccccttataatatctaaagcaatcctccagcattgtcggccaaaaataccctgcacgccgaagtaaccacttcatcttatgggccgattggtgagtgccacaaattcctttatgaacttcgccgattgcaactttagcctaatcggcactcaaacacttaagtaacactccatcaatcatccgataataaagctcatcatccaatagagtgtacttcaacgccttatatcttaatttcctagaagccgactgagatgtattatgtaaatattgatgcacatcatacctccaatcatcggctgttattgctgcaatttcaaccttaacatctttgatcatcggcttataccccgatgccccttgggtcagatcattagcttcaatattttgttctcgagatacatgctttaaagtaaccagccgaaattccttcatcagttcttggcacttctcattataaactattaacgtatcattcttgcattcatactcccctgccaattgactgattaccagcaaagaatcccccatgatttcaatagcatcggcttcaacttccttaagcaattgcaaccctttaagcactgcttcatactcagcttgattattagtcgcataaggtttaatagtataagcaaacttgaaacatgccccctaggggaaattataactaggccgataccacaaccatgagtacacaccgatccatcaaagaataaagtccatggcaccatttcaaccgagccgattgaatcatcacgatgttccacaataaaatcggctatagcttgtcccttaatcgccttcgatgactcataccgaagatcaaactcagttaaggaaaatatccactttccaacccttcctttcaatattggagccgataacatgtatctaacaacgtcggccttgcatataatagtacattcattggacagtaaataatgccttaacctcgtgcatgaaaaatataaacataagcataacttctccacaggagaatatctagtctctgcatccaagagccgacgactaagataaaatacaactcgttcttttccatccaactcctgaatcaagactgagccgattgacttctcaccggccgacagatacaatctaaaaggtatccctttctgtggaggaatcaaaacaggaggggaactcaggtatcctttaatattatccaaagccttttgctgctctgccccccaagtaaactgctgatcggccttcaatctcaacaatggtgtaaaaggttctaattttccggacaaattagaaataaaccttcgaacaaaattaatcttgccgatcatctcctgcaattcggtcttgttttccgggggcttaatctttttgatcgcattgatacttctctgagttatctcaattcccctctcatagacaagaaatcccaagaactggccagccgataaaccaaaagcacactttgtcggattcatcttcaagccatatttcctggtcctctcgaaaacttttcttaaatcggctatgtcgtcttttattcccttaaatttaacaaccacatcatcaatatagacctcaaccagccagccgattagattatgataaatataattcatggcccgttgatatgtagctccagcactcttcaagtcgaaagttataacaacccattcaaataagccgattgcaccaggacatctaaaagctgtcttatggatatcttcttcagccataaaaatttgattataccctgcgtttccatccataaaactcaaaattttgttccctgacgcggcatcaaccagttgatcggctactggcattggatattcatctttcggtgtagctttattcagatctctaaaatcaatgcataccctcaccttgttgttcttcttgatgacaggaactatgctagaaacccactcagcatatcggcaaggacgaataaaactagcatcatataaacgcttaatctcagctttgacaggttcaagcatatcggctttgcatctcctcggaggctgctggtgcggcctaacccctggtttgataggtagccgatgttctacaattgatcggctgagtccaggcatctcataatactcccaagcgaagcaatctctaaactcttttaagagctctatcagcttggttctaaattctggagacaaattcttactaataaatgtcggccttggctgatcgcctggacctatatctatttcttccaaatcatcggccgacataaaaccttgaccttgcttgtcatcgagatcatctaccgtatccttagtgtagacacttgaaccctccacgacgccctcaaaataatagcttgggttctccatcttcaactggctgtatatcagaatcagacacttttagaaaatctccattccaaacttttccagataaacaatcaaggccatccatctcccaaatagctaaatctgcactggtaacattaactgacctgtcggctggtacgatctctattttgtcgccttgccactgaatcaagcattgatgtatagttaaaggaatacaataattggcgtgaatccaatcccttccaagcaacaagctgtaagaacccttcccatcgatgacaaaaaacgtggtaggaatagtcttactgccgactgtcaactccacatttagaacacctttggtttccgatggattgccaccaaagcccttgagcaccatatttatcttgataagatcctcggcatttctacccaacttcctgaacgtagcataaggcatcaaattcaccgcggccccaccatcaaccatcattttagacatcggcttcccattgacatagtcatttatatacaatggtttaagatgccgattctctgtcccctcaggcttctcgaacaccgcctgttttggtgacagaaccaacttagccgattcctcttccacctcgtcgacatcggcttgatcgatcccgaattcagttggcaaggtaaaaaccatgttaactagtgccgtcacaacactctttccttttaccaacctctttgcctcatcagctgcaacatcatcggctacatgagcctgattcttaacacgccactcctgcctcggttttgctttcttcagccgatgattaatttcttgctcgacctcctggaagcgttctctactcctcaatctttgaacccttcttttctgatttttcgtaaaaataccaggaggacaccattgagtcttcttattttcgtcatcttccgaatcaccacgttggtttactgggcccaatctctgatgaacaggtactcttgtctgttttggccaatttcctccatcgtacaatcggcttgaaccccctgcaacatcactgcatctaggacaatcctcgatagatggtaacctcatacattcattccaacagaacctgaagaactcacagccccaatgaggatcaaagccaccattatcttcttcatgatgcctttcctgttgcttgtcgtatttcctttgatatttgtttataattctagctgaacttacttgataacccctcatgcgccccgtatcagttgttcgaccagctgtgtgtaccatgttaacgggaaatgggttaccatcgaccctcatcggctttttggaatcatcaaacttaatcttgcctccctcaatggccacctgaatctgttgtctaaacaccttgcaatcgttagtagaatgggacccagaattatgccatttgcaatatctctttttgcctaattcctcatccgatggaatcgtatgaccagcagggagttgaatttgcttctctcggagtagcagatcaaaaatcttgccagctttagtaatatcaaaatcatacttctcttcctttccagaactctttacccattggcacggtatgacctttttactcctcacccattcggctgcagctatctcagagtcatcttcatcgtcatccgacccatacatgtagggacaaacatgattaatcttcttagagcttttcctagcctccgcagacctatgctcatgcaaggttaccttttgtatcagatgtgacaagctatcaaagtcttcagacgagaatttctccctaatcgtgcaatcataccctgaaaggccagatcggctaactgagcgtcagttaaactcaagctgaagcatttgttcctcatctccctgaatctctgaatatacttgtgcacaggttcatcatgccgctgcttaatcgccgtcaagtcagataacttcatctcatgaaccccactttagaaatagctgtggaattgcttctccaaatcggcccaactattgatcgacccatacggcaaagaagaaaaccaagtaaaagctgatccagacaaagataaccggaacaacctaaccctcagagcgtccacagccgatgcttcaccacactgagctaaaaatcggctaatgtgctcataagttgacacaccatcttgtcccaaaaatttggagaagtccggaactttgaaccgattggggagaggaactctctcaaaccactcagggtaaggctgccgatacaagcttccagtctcttttggtttaagcccaaactgttccctcattacatcagcaatcacatcggcccacggtcgttgctgagctgctccctgtgactgttgttgcatgggctcgaactgaccgtactgagacacaaactgaggttgagccagtccccctgactgatattgggcttgcggggaaggatgatgattttgataattcaagttgcccctggtaattatgaaggttcggctgaattttacgtgccaaatgctcgggaacaacttgaggcattactgtgccatccggctgtacatggtgaaccaagtgttctgggacgacttgatttaaaattgttgtacaggctgtccaccaggcgtcacaaacccggccgatacgctcattgagccttggtgctgaatcggctgaacgatttgctgtcttaacgacgtttgctgaatcggccgcggaggctgttgccttggtggcgtttgctggactggttgcacaacttgttgctggattggttgtacaacctgctgactcgggagtgtctgttgaatcggctgctgctgtattggatcaatagcaggttgaggcggcagaaacatggcagcaatctgatcttgcgttggccgattcacaacctgcccactatgctgtggctgctctctcattaacaaccgagggtttaccagctggcctggtgccaatactgacggagtaggtaagggagtcgatgccggctccgtcggctgagctgatggtgcgacggggggaactgcctgaatagatggttgggtattagtgatcaaaggccgataatttggaaagacacctccttgaaaataaactgggcctgcagcctgatgctcaactattgatccatcggctattgacttcatcatgtttgataaggtattgactaacaccctagactgattgatcaaagcatggtgcacagcatagtcgacccggtcttggaaattattgaaaaaatcttgtgccgcatcactattctgattaagatttctcccttgcaacccctgagcaccatcaccttgaactccatgcactccatcgccttgaactccatggaccccttgagagttgtcaccttgacttcctagagaaccgtcggtagcccctttgtcactcagtcgagccgagccatctggagcttgtttcccgtcttcacctttggaagaactggtcccagggtcatcggcaactacctttactttatacttctgaaccaatgttcccttgcgggtctgcatgaatgagttcaagaactgatcccgggcttgctgcaacattgcttcaaaatccttcttctgctcaggtgtgaatttctctggatcgataggcacgacgtttccttcattgatgtcagtcaaccccaacttctggatcttttctttaacagtgcttgggctagccgaggatggcgacagcggtggcttctcggccatgaggaagaattgcttgctgacttctaattggtcccaccaggcgtgccaaaagcgtgttgacagaaaacacgaggcctgggagatctgcttaactccagtgcaggtccaaagctcgccttcgaatgtatgagcgtgccagttgatttgatcctgtaatcaacaagaaatagagacaaagaattcgtggttaaatctataaatgatagtcgatcggtaaggtgctgatgacatatcatttatctttgagccgatgtcatatatgaatcgatcggcggttataaatagatattaaggaactaaatctattcgatcggctgtagatattaacgatatatagttcttatattaatatatacttaaatcaagtgattgggatagatcggtcaccatgccgagacagtataaatcacttagatcgaaatatatattaataacatgattatatatgtttatagcatagccgatcagatagatctagcatgtatcggctaatactccgatactactttatataaagatattaaaacaaatataatataccaaacaaaagcttaatatacttaaatgcaataagatcctgacataaagggcggatttaacatgtcattgaagcatatagatcgaatatggttaaatcagataagatcggctgaaactccgatactaccctaatcggcaaccagaggacaggctagagattgatattctaagcacgacttaatagatcaaactcaactgatgcagtattaagtatgaaaagaagaacaatatctagacaatcaagccgctgggttttcataaagtggtagatatcttatataatctagaacaacatcgctatttaacctaatcggctgtcttctattaacagatgttagccgattgtaggttagatgatgatattgccaaagattatgtaggatatatgataacttgacgaattatatagacaagattagagtgtcataaagatagaatcactaatctcgagaacgtaagtcgtcataacaagttttacctcttgttgaagatcgaaaccgatgcagcttaacccgaaagcaagaactcgtcgaaacaaaactaaagcaaaaaggtggcgatgcgccgaaattgtattgaacgtgtgtgttctttttttaaattacatagggctcggggtctatttatacccgagaattacaagatatgtccataccggacacgaccactatctctaacaaactctagacttttgcccaaacatatctctaaggaagttacataaaacagcataattaatagatacaattgccttctcaggactctatccatgtgcggcaatcatcttgaagcacctcaattcaacccaatatcatacaccaaatcatactgtcagaatcggccgcatcagctcacctagtccgactcagacccagctgatcctaatcgtagccgatctggatttcagccgattcttactctgttctcagatcaatctccgccttcgactccaccttgatctaatctccttttccgatgctgatattaccaaatttggtcgttaacatacgcacataccctcgaatgttagtgagaataggaatataccgttggtttccctttctgtttcgtgttaggaggcatattcgtgggtgtgtaagtgtggtgttgtgtgtgtactagtgtatggtgtatgtacgtgtgcgtctgtctgccatgtaattgaaataaggaaaaaaaaacaattctttgctacataatgatggcgagaaaattgtttgtttgtttttgttttgacaggtgcaaagcacaagagggagtgtggcgagctgaatgcgccgctgccgctgtgcgaccccggcggcgacgcctgcatcgcgtggtgcatcaacgagggctacgccaacggcaagtgcttcgtgtcgaaactagatttcggcaataataaaagggggtggctatcaagctcggaaagtgtatgggtttggagacaaggaatttatacaggttcaggccttcttataaaagaaataataccctattcctgtccgggggatgaatccgccgagtgtattattgattgtatgatttgggaaaaaatcagcatatgcccctagaggcgcccggaccccccttatatatgggaaggagtccggattacaaaagataatctatattcctaacggaacatgaagatacaggtaaaatacagtcgtaaccgactaagtctcagggtgtttccttgatacacaagttaagaaacaaacccaagatacagataagatattctatctacattaagtatccggtacccaatccaaataccgttgccgtgtagatatgggatacccataatctccacagtagcccccgagtcctttgcagtcgaccatcatagtcttctcaaagatagtaatccgagtgcttcaaactcttcaagccaaaacctgccgagtggactgtaaagggcgaaaagataaagaatatggtgcatcgaatagatgcacctaattaggtgtagcccccaactatgtgattagttaacaaactaatcatatagttgaaagacaaaataataacacaattgtgcattatatgacaaaagcatacgcggcgcctaaataggcatgctagccgaccgctttttagccacaataaaagaaatccgagtggattacactctaaaaggttcacgaatgaacacacttgacaggcatccgaatataaaaactctaaagattacccatcaagtattatgaagattatggtaataaataagtcgaatagcctaggccatgactatttaccataatgaaaataggtatatcacataccaaggaagtgactatagtaaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgtaaagctgcgccggcgaactagggttcacaactccggccaaatccacctccgaaaagtgcatcaaaatccttcccgtgatccaccgcctcaatccctcacctctcccaagccatccctcaaatcaaatcaacacatttgagtgaaaccaatggcggaagagagagaaagcttcgaaggccaatgggcgtcatccgacgtaacagaagagaatcttaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccgtagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggctggcatgcaaactggttctatgttcagaatcccgagcctgctcttcccgggtactcttgtcttcctccagtgtaccaagatacttggaactctcttccaatcggagatgaagcagtacaagccttggagttgttggaccgtatgttaaatcttaaagaacaaggtttacagggagagcagatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcatcagctgccagtagtgccatataatgcgttcaatccgcctccgcaggtatgcatctgaaatcctcaatctatggccaaaacataatttcatcttcatgctgagttgactaactatggaagcatcttgtgcaggaatatgcattgatgaagtcagatccaccagtctctcagcgtcggtctcctcgccaacacaccgttcagggaggtggagggccaacgatcagaccagatccgcaacctcagacctccaaattggctggtcaaacaggtcctcgcaagagaaagctggttcttgatgatgatgaaggcgacgatgataaatctggggataagggctcgcctaataaacccccaaagcgtaccatgcccaggaaaaaactggctggccgtgcaatgccaaagatcagaacatcttccaggtattagacctctcgatatgattccgcttcagcatgttatgctcatgaaaatgatgctgaatactgaaagaacactttgcaggaaaccatctgatatagatccatctggaaaagaccccgatcctgccatgacagagcaaaatatatccaaggaccccgagccgactgctgaaaaccagccgactgctgaaagccagccgactggcgcccatgcttcgggcgatagggccaacccaagtgacctgccgccgactggaaaccagtcggcaacaaccgaagcggcaacaactcaagaacccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtgtatccgtctaatgtcttggaaacacatcaggaccatcaggtgatgacggagaagaaattcctcgcataaaggcgaccgacgactctcgtcctcctatcttgatcaaatggtgggacgagaactcacaagctgccggcatagtcataaaccgtcaaaaagaagatgaagaagtgtgccagctgaagaaagcgctcggagaagccactcgtattgtaaatgtaagtcttccgagtgacggccttcagtaactttgttttctttttagcagaactgaaccatgatccatcatgcagagaatccatcttcgcaatgaggccaagactacaactttggaaaagctggttcctcatttgggaactctagaagcagttagggaccagctgcatgaggccaaggagtgcgccaaaaagacagagaaagagttaagggaccgaatcgcccagctccaggatgcaaacttcgagctaagtggttcatcaaaaggtaatcatctagatctgttccattgatttatactgtcataattgcatcctcaaatatttggatttcaaacagcgcaagccaccagaatggctcagatggaaaaacagattgaagccttgaaaaaagacaaagcaggactggctgcagaaagggactcagccttgaaagaaattgaaggtactgccggctgatgatctgaactttcctctttttaatgcagtagagtctgattgttataaatgtgttctgtagaccgtaaaatcaagtctcaagctcagtttgacgtcctggttggtaagatcaagaggcttgaaggagcaagagatgaagtcgccaatgtcgctacaccactcatccaagccatgttcctcaataacagtggtccgagtgcactcgacgcaaccgaaatattcgacaagctgagtgttgctccggatgtatatttcaaaaatatcaagaaagctggaagtatgggagctagcatggccttggcgatgacaaaatccttgtacccgagaattgaagttgataccattgatggatttgcagacgggacaagtgaagaagctgctcttgatctcatcaataatgcgcagagtgcggctgacaaaattgcgagtgatgttgtagagcaattccgcaacaacgacctccagccgagcgataataactctgatgatgaaaggactgattctgactgagtgtaaatgtaatacatggaggctcaatttgtacaatactggtgtatttatgctgtgcttgatgattcttgcgaagtttttgatttcttaaaagtttttgctaagctttattgagcctaaaacccaaagaagctattaaaaactttcagtcctcgcaaactaagtagaaaaaccaaacaaggcaatgataaaccaagtaagcaaactgaattgataaaaaatcacactccattattatgatgatagcccccgactggcaacttcaaggagaaaacttgatgtttgacagtcaaaatagggaaatacaatgataaagttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactaaaaaggcacgagatcgaacattgcgattatgataacgtcgcaacccttgtaagtaccgagctgactgaatcaaagctgcttcgcgggcctcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccgttggccctctccacctgtccgttgctcattgggtgtgctactgaagcatagcaaatcttgattccaaagtcttcacaaaagtctttgaaaactccgccggtgaattgtgtgccattatcggtgatgatccgattgggtactccgaatctatgcacaatgttgatgaagaaatcgcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtttgcaactcttgagctggtagatgaatttgtctggcaaaaaattggcaaccttcgcatgtgcgcacaattttgtcggcgtcggacactgcagtaggccagaaaaaaccctgccggtaagctttgccaacaatggtgcgcgctgcagcatggtttccgcatatcccagaatgtatgtctttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatggcgacatcatgggtgcccgtaacttgagtggcatctttgtgaggtaccgtcggcgtataaaggtgttcgacaaaaacatcagagggcgctgcctcgcgcttggatccaaagttcgcaagtctatcggcagcttcattgttgtgtcgaagaacatggctgagctcaagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcttcatactcggcgacgttgtgagacgccgaaaaatgtatccaaagcacataacttagtctttctccagtcggggaaattaaaaccactccagctccagtgcccgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattaaaataccatataacagcttctgaacctgagggtacctcgttttggagtcggccaggacctcgctgatgaagtagattggtcgctgaactttctggacatggccttcttcctcacgctcgacaaccaagactgtgctcacgacctgggaggtggctgatacatacagcaacaacggctcctgcggatgtggtgaggctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttaatccaaacggcatggtgacgtagcagtatgccccaaagggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaaggatcttttgggcaagatttgttaaggtcagtgtaatcgacacacatgcgccattgccctgttttcttccgaactagaaccgggtttgccagccagtcgggatgaaggacttctttgatgaagcccgctgctaacagcttggtcaattccaccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcggtttccccactttttgaaattttggcagcgggcacttctccttcgctcaccgtggttgcagccaatcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtatgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccgccatcaatgagggttctgcgaaacttgacgttacggaccactgggtctagtaccagggggtaccgccccgggtggaccactcggtcaggatgatccgagcggtcaaacttgattgcgatctctgaccatcgaagatactggggcgtgtcaggttgaacagcattgatctcccgttcagtcaacttctgcttccgtttagactcataagccagggggccgccaaagatatggttgagctccttgcggtggtcttgaaatccagccgggatgtcgccgtcgtccttcttccttgacgtgctttgttcctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccgaatttgccgaccaactcttcgtggcgaatccctttggtgaatgcggcgatgatgacgtcgtcggtgatgtcggagatcttgttacgttgttcagaaaatcgccggatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatggtagcctcgagctgctcggcgctgtgtgattgtgtcgcgaagatcgatggggcggcgacgaggtggtgagcgaggccgttccactcggcgctccccatgaagttcgggaggcgagtgaacagaccgctcgtcgtggcccctgctcctgcgattggatcctgctccagtgatgctgaggcttggatgacggtagtcatgagatcggaagtgggggacccggctgccagtcggcgtgtggacgctttcggagttaactgggaccgtcgccgcaatcatggtcttcgtctggttcaagatgttgacgacgtggtcggaacgattgagctcgttttggttgaggagggtgtcgagaagggtgatcgcggcaaccgcattctgttgaggggtgcggaaaaccagtgtcccttcgacatcttgctgaccgatgagatcacgtgctcggcgccctgcttccaaagctcgctgacgtcgatcctcagcctccttcgcagtccgctcacggtcctgctgctcgcgccgtagccgttcttgttcttgtgcttgatgctcctcctccagtcggcgtcgttcctcggtctcctgggcttggcgttgctcctccgtctcattattggccatgaaaacgccaaagtagagaggggtgtagttgtcatctaggcttccgtcgaagtcgtcgaagtcgttgaagtcgttgtatcgagaactaaattcgtcgtactccacgatgtcagtaggacgtgagtcgacggtgggagagctgttgtagtcatccagctgatctgtcgaaaccgtgccgagtggttggaggatgacgccgacttccctgaagctaggcgaactcggtgttgaagccgacttccgcctaggcctacgggatgaaggcgctgtcgtggtgaagacggccgctaaatcgtcggggagcttcatcaggaccggtgggtaagccccatcatcttgatctggtatcgttggagaagatgcgatctcggccgagtggtttgaagccgactcggttgagatggtcttgaagtagctttcagccgcgttcgggaatccaagcgggaccgaaagccggttctctcccgactggtctgattccgagtcgaggagagaaatcttgccgaagttgttggtgatgaagtcgaggctgccgaaccgaaacgcctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctcggaaagtgtatgggtttggagacaaggaatttatacaggttcaggccttcttataaaagaagtaataccctattcctgtccgggggatgaatccgccgagtgtattattgattgtatgatttgggaaaaaatcagcatatgcccctagaggcgcccggaccccccttatatatgggaaggagtccggattacaaaagataatctatattcctaacggaacatgaagatacaggtaaaatacagtcgtaaccgactaagtctcagggtgtttccttgatacacaagttaagaaacaaacccaagatacagataagatattctatctacattaagtatccggtacccaatccaaataccgttgccgtgtagatatgggatacccataatctccacacttcggcggcgacaccggctgcacctgcctcaggccgtgcccggctccggctgctcagcccacgccggcaacgccacgaaaatgggctgattttcactgaaaatttttctcatcaggctttcagttacgttggtggtatacatgcatatactatcattccttcttacaccaaggaaattcatctttacggtgctctttagtgataatattctattgactattgccagtattatcaccaataaaaatgattcccataattggcttatgagttatgttctgccatttgtacgtattacatccgtgcaaaaatagttctctctaagattgtcacttttgagtattacatgctaagattgtcacttttgagtattacatgtctcatcaatcatcttcattttagttttttttattctaccctcaactatccttgcacatctataaccataccctatttaataaggagcactatagtctttttctttaaaccttaatctaccctaaacaatttagaatgacaactatactacgacggagggagtacatatgattcactagattaaaaaataaataaataactggtctagattaattatactaccacaaaacaaggatatcatttcatttactccattttttttaaaaaaaataaatgcaacagcatggatttgcacataaatgcaagtgtatctctctctacacataaattcggttggaatcaagctatgcacattaattcattgcagatgcaaattaattcctatatatatatgaacgctgcccccatcccatttacatccatcccagaaaattctctacacaaaaattagattaatttgctcttaattcattcctggacttcttgacccccctcaaaaaaaaaaaaaaacctctagttgtcgaacagttcatcatccatggagtttcagagcagcaagatcgcagctgcattcttcgtcttcttcctcctcgccaccggcggcggcgccgccggcgggtgctccgtcggcgagagcagcacgttcagaggcaactgcgagatcgacggcggcggctgcgtggagtcgtgcaggggcgaggggtacaccgacgggtactgcttcaccgaggtcgccaaccctggctaccacgtctgcacctgcacccgcggctgctactcgccggcgcagtcgacgaggaagatgatggcgcgcaattaattagctgatgattgattcgatcggcggcttgtttgaattgaatcgagtttcggtttaataatcaaataagaaattaagaatcaagcagagttcattcgaatgtgacgtagaggggcttgataggaatatacaggtttatgacaggggctattatgaaaaagttccagaactaacgccaagcgacgccaggagaaaattttcttagagacacgctataaaattaaagcagacacccataacacgtgtatagttaccctatgaacgtacgtacacacagccttctcatatgagtatactttcagaacactagaccaatattttttgagattgacgaagtcactacggacgtctcgttgcttaggggtgaaaacggagcggatattatccgctccgctccgaatccgtccgatgtgaggatatggtaagaatctttagatatccggccggatgcggatgcggatgcggattttatcatgcggatgcggatgcggatatggtatcaacgatatccgacggatgcagattatccggtattttaatcggattatccgatgtactgtttagcggataatccgcacctttcaggctatacaacaactctatttagcccattttacatcggacggcccatctagcctatctagtgtaacctaatccaatcctcccctaaatctctctctctatgtgactcttctctcggtcccttctcctgctcccacacgcgccgccgcatggcaccataggtgcgccgcgccaccgttgcagcctgctagcgccaccgtcgccactcctccttctagttcgccgacagtgtgttgtgtgctgtgtgctgtaagcagtgtgctgtatggaactagtgtggtgtgtgccgtatgcagtgtgctactgcgttgtgtggttgtgtgctgtatgcctatattgttgtatgcttcattgcctcatgcctgtcgtactgatgagtgaactactaaactgaacactacatttttaaattttaagcaacgcagtgaactgctgaactgaacacttatattatgtttttgatggatatgttatattaagcaaaattatattattgatgtgttttggttggtttttcatagagagctgagatcatgttcatatgttgtttggccatcgtattgcagctaattgtattgccgccctcttgttgtatggattgaatacaaacttgacatccgacaactttttgtccgtttccgaaccgagtccgcaccgactccacaccgaatccgacgtacgaaataatctgctccgcatccgcacgtcatccgcacccgctccgcatccgcttaaaagaaatggtttaggatatgtgacggagctcgtggctcctcaccgggagaccgcgcaggcccccctttgccggttcggccgggggcttagggtgcaatctcaagctctcgctctctctctgtatgtggaaagatcgtctgccagcaagaaacacgagacaccggcgatctatacaggttcgggccgctgagaagcgtaataccctactcctgtgttttggtggatctgtgtatgaatgagttacaaagtgtgagctgacttctcccccgttctcagcactcaatccgggaaagaatcaaccccctctcaatgggcaaggtcctccttttatacttcaaggggataccacatgcacccttccctttccaaactggactgttctttttctctttaatgggcggagattggtatggctgctgtccgaacgacacttcgatgggacagcccacacctacctccactcccggcggagacgggcgcaacgtgagatcgtggctgcccgttgctgatgcgatcagtgtcagaccggtcattcttgtccaccacgcgtcagtttaataacatgcatgtttccccttcttcgtgtaacacctcgcctgtaatggttaggatgaagcctggtattcatctaaccagggctaacgtgccatctctaagaaataacacgctagctccggcttgagacgagtgcctagaggctttcgtcttgacgggatggggcaaggcgtgcgtcagaccgccagtcgccacctaacccttgatctgaccggtctgtgactggtcacagaccggataaaagagcgtgctgtactgcgatgcacgcaacgtgacacgcttgaccagactgcaatgaatgctgttaggtgagcacagctgtgctcacttatcccatatatgtggcgcagacttctttaaggggtcggggtgccccggccctcggggccggggcaagcgcaacccgaccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacagtctcaatccatgcaccttggtactggtaactttggtggtccataatgggcggtctattcaagactgccacaccacttgagcagcgcgcgaatctgggcgagcagatttgtctcgctcggagatacggtaacgccgcttcggtcggcgagcgtaattaacgcgcgcacgatacaatccgtttcgattgccacaaccgcatatccacttcatgcgccgtaagcgggcgaatgggattagtggaagcgtgggcacgggaaactagggagcgagatagcgagatacgagggagcgaagtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctaccttcgccacacacgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccctttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaattgggacgactggaagagcgactggttctacaccccccttgccgacgaagcgcgtctccgacttccaagccagcccccggcgcaggtctccagctggcgggcgccggtagatctgggggaggagtacgacgccgtcctcgaccgcctggcgggcctgcgatcccaagggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctctgcggaggcgtctcgcattcctcaagagatcctccccctctgcagcgatcccgaccgcgcctccattctaaccattatgatgggggtcggggcctcagaggagagagcccctaagggccacgacggcgcgggcgagcgccgccgggggaaacaatctgccccaggagggggtcgtgcttctgggccccgcgtcgggggctcggggagcagccgccctgccgacgcccaggggaaaaggaagctgggaggaacacctcccccatctcctccccgagggggcggggcggcgcgtgccagcagtcggcgcccggagggggccgcgccggcgtcgcagcccgagggggagcgcaagaagaagcggctccgcaagacgggggagacggagccatgccggggaaacctgatttcccctccaaggtggtcattcacccgaccccctcgcaggttcgtctcgctctcttcgcgatcgccttttcttccatcctaaaagcaagttttttcttactcattttgttcgtcttctggttttttcttctgcttcagcaatgtcccgtcgcattcctcccgccaccccaagtccggccagtccgaggccgaagatccggcggctgcagaggagcggaggcgagaatctgaccggcgtgaagccgcagatcgccttcgggaagccgaagaggccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcactcgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgtatcctccggggggccaagccgtgtcacattttctccaaggcggcttttctcctcctcttccgtcgccccggtgagcgccgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagctcgaagcccgcaaggcggcgctggcggagatcgcccgagaggtggaggaggagcgagaggccgccctcgtcgccaccaccgcgatgatcgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagacgggcttcatggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacagctggcgaacagcctctccctccgcgaggcggcgcaagaggagcaggcgcgccgcaaccttgaatgcgtccgtgccgagagagccgcgctggagcagcgggctgccaacctcgaggcacgggagaaagagctggccgcgagggcgcgcatcggcggggcggctgcgggcggaagcgacttagccgctcgcctcgcggctgccgaacacaccgtcgctgacatgcagcgcgcgctggattcttccattggggaggccgaggccctccgcttggcgggcgagatggggcccgacatgctttgggactcagtctcccgcatggatcgcgccggtcggcaagcgggcctctggaaaggccagacgaggacgcgccctagcaacctggaaggcctcgctccgcacctcaacaggatggcctgggtcctcgaacgactccccgaggagctcgagaagaccatcaagtcatcctcgagggacctcgcccggggggcggtcgaactcgtgctggcgagctaccaggcccgggaccccgacttctctccctggatggcgctggaggagttccctcccgggaccgaggacgacgcgcgcgcgcgcgtccgggatgctgccgaccatatcgtcgacggcttcgaggggtcggcccctctgctcgcgttcgcccccagctccgacgaggagggcgacgccagtgatgaggatgacggcggcgacgaggccggcgacccgggcgcattggaatgagcccccaggcccccgccaatcttttttttcttgttctttcttctaaggccttcatgcctcttttttgtacaaattaacttaatctgcaatcagaagaaaaaatttttgtgttagttttagtttgctatgcaatgagctgaggatgatctgtgccgtgatcctcttttcgtgtcttagcctgatttaagggcccgtgcccaagtcctaatcctcgaagggcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaatttgaaactgcttttattgaaatgctgaaaggaatatatgtgcatgtgtggtagcccccggctaaccctgcacacccgaggggggtgcggggttagcccgagccaaaacctgacacccgaccccccccttcaggggtagaagcgacgaaggtgttcgatgttccacgggtttggcagctccgtgccgtcgcccgtggccagccgtaccgagcccggccgggggacaccgatcactcgatacggaccctcccacatcggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctggtggatttgcttggcgtggaactgacacgctctgcatcgccggaccagatcgaccgcgtcattgagagccgtcggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcagtcctcaggtagagtcttatctgtgaggtatgtttggatctcagagatccaagcaatcaatctaagggagcttggagcgctctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccttctgggtacatgccgaagttctatcccatcgaaatggcgctccatacgccgcacttggcgtacgtaggcgtccatctgcgggtcagagcaccggtactccttacagacttggttaataaccagctgagagtcgcctaacaccaggaggcggcggatccccagcccagctgccaccctgagtccggcaaggagtccctcgtactctgccatattattggtcgctcgaaagtcgagacggaccaggtatctgaggacgtctccgtttggggaggtcaacgtgacccccgcaccggcgccctggagagacagagaaccgtcgaactgcatcacccagtgggcggtgtgaggcagctgagaggggttcgtgctggcctcgggtattgagacggtctctggagccggggtccactctgccacaaaatcagcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcataaagcatcttctgggcctgtgggtatcgggtcttggcgtcccggagggcctcactaacaaagtaaacaggccgctgcacctttcggcggggccgatcctcttcgctaggggccgtatccccggggtgctcttcgtccaagtggcccctcggggcacactcgtcttctgtgctgatgacctcggggtcggaggacgacaggagcggccttcccacagtggcctcggggccgtcctgggggtcgggggctcctggcgtcgtcagacaagcgagcaaagggccagctccggtcgtcaggggcctcaggcctcctttcggctcgggggcctcttctccctgctctctcccgggtcgagtcagcacagggttagcctcggggtcaaagggcggtaagtgcggccttcccttagtggcctcggggccttcctgagggtcgggggcacccagcaccgtttgacaagcgggcagagggccgactccggtcgtcgggggccttaggctaccgttcgactcgggggcctctcctccctgcctgctcccgggccgagtcggcacggagtaggggtgcgcaggatgaggattgtcctcatcgcgctccacaactaacgccgcactaaccacttggggggtcgccgctaagtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccagtgacgcattgcacatccctaagtttgctaggggggcgcatccgctcgatagctcgaatcttctcggggttggcctcaatgcctcgggcagagaccaagaacccgagaagcttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctctaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccgagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggttcgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggccagaagctctcgcttcatagccttgaagctccggcgagagatgtgagcacatgctcctccatcgacggtggcaatggtggccccaggttcttggaaacctaggtcatcattaccatcatcgatgtcaacagcgggggccttctgcttggcctcacttcgccgtttgccggaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacttgccggcggggcgctccctgctgggagtaccagcctctttctttttgtcgctcgcaggcctcccctttcgggtggcccgcagagcgccctcgacggcgaggacatgaccctcgtcgccggaacggtccgacctcttcttcctcctcctgtcacgccgccctgtctgagcggcggatccgggggcggccgaagctgccactccggaaccggaagagttccatgtccacgcttcctccttacgagccactcggtccgcgagctgaaaaagctccgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgatgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccgacaccacctgccgggggcacggagggctgatcttcacgtccgtgtcgaggtgacactctggacgaggaggcgccctccgtttcacggggagtacgccggctattacgccggcgctcgacgttgaggcgggcatccggctccccatgctgatcctcccgagtcgacggtgtcgacgagggagtggcagccgaatgacgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcaccagcgactggtgatgccacggatttgtcgaccctctcaagcgcctccccctgcttagggctttggcgcggaggaggtggtggagtacgagctcgacggcgtggattcggctccccgtcgtcgccgctcacacttggagagaggtcgtgcgcttttccttgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccggttcggccgggggcttagggtgcaatctcaagctctcgctctctctctgtatgtggaaagatcgtctgccagcaagaaacacgagacaccggcgatctatacaggttcgggccgctgagaagcgtaataccctactcctgtgttttggtggatctgtgtatgaatgagttacaaagtgtgagctgacttctcccccgttctcagcactcaatccgggaaagaatcaaccccctctcaatgggcaaggtcctccttttatacttcaaggggataccacatgcacccttccctttccaaactggactgttctttttctctttaatgggcggagattggtatggctgctgtccgaacgacacttcgatgggacagcccacacctacctccactcccggcggagacgggcgcaacgtgagatcgtggctgcccgttgctgatgcgatcagtgtcagaccggtcattcttgtccaccacgcgtcagtttaataacatgcatgtttccccttcttcgtgtaacacctcgcctgtaatggttaggatgaagcctggtattcatctaaccagggctaacgtgccatctctaagaaataacacgctagctccggcttgagacgagtgcctagaggctttcatcttgacgggatggggcaaggcgtgcgtcagaccgccagtcgccacctaacccttgatctgaccggtctgtgactggtcacagaccggataaaagagcgtgctgtactgcgatgcacgcaacgtgacacgcttgaccagactgcaatgaatgctgttaggtgagcacagctgtgctcacttatcccatatatgtggcgcagacttctttaaggggtcggggtgccccggccctcggggccggggcaagcgcaacccgaccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacaatatggtatagctattatccgtccgaatccgctccgttttcacccctatcgttgctgataggtacgtcatctaccactaaaagattaattagccgtatatacgagcacccatgttaaatctaagatttgaaaggaacgcatatacgcacactctatccctatgagcaccttcagaagactggactaatgtttcttgagattgacgaagtcatcacggacgcctcgctatcgataggtagatcaccgaccactaaaagaataattaaccgtgaatacgagcacctatgtcaaattaggatttgaaaagaacgcacatatcctattcctatgagcaccttcgaaagactggactgacatttctaaagattaacgaagtcaccatagatgcctcgctgtcgataggtacgtcacctaccactgaaagaattataagccataaatacgagcacccatgccaaatccaggatttgaaaaaaataattacctgtaaatgcgagcacccatgttaaatttaggatttgaagccggatgggttggtttcattataagtaatctaaccaatcgagttacgctcactttgcatgccagcagaaaattgtttgaggatcaaggtgttattcgtaaaattgctgacgatctaaaataggagggccactgtgaaaagttctctagaatttcacccgttagatctcagaggaagatccctagccgttggatcaagattatccgatctctctttcttccccctcgattcatcgccgccgcgccgcctcgccggccgacgacatccccggcgagatccgccgccgccaccctactctcctcctccggattcggcgccccgccggccgccgaggcctcctccaaacccttaccctccgcgcggcgccgcatccttctctctcctagttcgcgcggcgacgatggcttgcgtggcacacgaggaatccattgatgggtagatgaaatcagcaaatgcatatttacccctgatgaagtgagctactctactaacttgtcgtaatttttttgttgctgttgttgttgctaagtaggagtaaaacttatttttgctaagcatgctgggatgagtttgtgacattttcggttggttttgccactgagaatatatcattgattctttgtgcttgagagaaacaaatatatgtagaaataaacattgcatgcaaagatgaattgaaacgagacaaactcttgtaaattgtagctgcttttcattgaacctctctgcttcaatgaatgaacttaattagtctcttgtatttatctttttttttcgaggggataggcagggagctcctgcaattcactatagaagaagagagagttgatccagtttataagggaaaaccggacccaaaaaccttacaacaccacggttaattaaaggaaaaccggcaaaaacctcgacattgacaaactgaacctaagtacagctatccaataagagataaactcctagaacgaagccttcaagaaggtcacgccgacagaacggcgacatcgtccgatcctaacgaatctaggtttttacccggagaaaactcttgaagtggagttgaacgagggctccagtagcaacgccttcaagaaggtgaacggcgcccaagggcgtcgccgttgctagcaccgagagcggagcaagactttcgccttgaagcagccatcaaccatagcatccacgacgggagccaccaaatgtcacctgcacaccgagggtacctgcaatatgcacaccacctgcacgacagccggatgccaaaccaccccatccccactcgaggatgcgccggatctgggcaagggagccagatccggccgtccccctcaccaccaacgccggccgacgcctagaggggcgccggaggacgccagtggccgccgcggggtgcctgcgtgctcacgccaccgccgggcgccgcgccgccgccggatccgcggcctccaccaccgccgtcccaatgccgtcgccacccacatcaccacccggcgcactcacctcagccgccaccgtcgcccgtccccgccgccgtcatcgaccccgccgctgccgccgccgaccccaccgccgaccccgccaccagcccatccccgggcggctccccaggccgtccaagcgcgaggagacgaggagcgccctgccgccgccgtccttgcggccgcgcggcctcgccggcggccgctccggcgacagcgaggcggagaaggggggtggggtggggggaagaggggtggccgggtcgcctcccgagccgcccctggggagagccgactctgggggagatctcttgtatttatctccatctgctgtaaaaagatatccatttgctgatatcctctctggttcacagaaaatagaaatgtccttggtggttggtgctctttggcctcctatatatacgcactctacacaagcaaattccttcatgcaaaccaaaaatagtagccaaaaatgcgcattcgatgagatgaatgcgcgcctctaaatttggttcagcatatataaacctttctcttcgatgccatttttaaacaattccatgccttgtttccatttctaaaagagaaacgaaacagtttcccttcttttttccccttctggttggttctcccttagttgatgccaaaccataacttctttccaactttaacaataaactcctccacgccttattttccgataaatgtttcaccttacttgtcctataaattggcatgccaacctaccctaagattctttctaaatcttatagcaaccggcatataggtttcggcatggtttgcaaggttacctccatattttcgtctatcttaatttattcactcctcaccgtgtcttgcggtaattgcagatatatgctcctctttgctgatgattataaatatttaggataaatttctccatatgcttctctgccttgatcacgtaattttttgtttgtttgtttgtttgaacagatgcagataatgccccggacacaacctgcgaaagtcctcaagcctgtgctaatcagtgtgttgccaatggctacctgatcggattctgcgagatctttactttgggacttggggattgcgtgtgcgtgaaatgcccaaatgcccagatgatgcatgctgaccatcttccattgcagagtcgcttccaatagagcaaatactactaaaaacttattgattgtgcaccttacggcagtgctaggggatgtaaaatatttccatcatttaaaagaaacagagcgatcacttttcgtatatgcgtatatgatgaacaccaccataaatgggaataaactggtgattgttgatagctgagttttggtaaatcaagtgttgagaagtaatggatatgtaaataaagcagcttggaaaatcagcagtgtgcaacttcggcagaagaaatgcttttggtggtttgagctccgagaatcagattgctcaaactgatcagtgaggattatatgttttttttttctcaggatgattgcgcctcacatttcaggtaactttgtcaatcagaaactattgcaatacttattcaattctaggactgaaaaacaaaaaaaaaacatatgctttctctgatatcaaaataaaaatgtatgagcatttattattctttcagagtgactgaaccaggatgtctgcattttgtactttccctgagatactaccaattagtgcaacacactgatgcagactagcatacacatatacaaacatgccatcaagcacacactgtataaagagccatctggaccctcacccaacaaaattcagttcatttcaggtcactgttgattctgccatggaggccaaaattggagccacagccatggtcctgctcctcctggcctttggtgagttcctcactgacaaaatgtaaagcagaaatctttactagttagtagcactaatcagacaccgaactggttacaatggtagcttcataccgacttgttgatgtgagcaggtgttgttggtgaggccaagacacatgaataccgcagccataccttcaaaggcgtctgcatccacgacgatctctggaagtactgcgtcagggtgagatctaggtacgatggatcatcaccggtgagatcctgatggtcgattggtcactgaagacgccggcagaaggagatataactatgtactccctccgtcccataatataagggattttgactttttgcttgcattatttgaccactcgtcttatttaaaaaatttgtacaaatataaaaaacgaaaagttgtacttaaagtactttagataataaagtaagtcacaaatagaataaataataatttcaaatttttttgaataaaataaattgtcaaacagtaaaaaaaaaagtcaaaaccccttatattatgggatggagggagtatacttgatggcagtacggctgatcaagatattagggatggattggaaagaataattagtgttgaagcatggtgtaagttaagtttttcagttgaatgaaaaagatgaaaggggaaatgcaaagaacaccatcaccgtggttgaaagattgggtgttactagtttactagtgagttttgatgcattttttactcaattacggttatcatgagcacaattttagtaacattgcacctgtgtcgcggcaaagttcagaagcactgggtagatgtatatatgggatcacgcttgtaaaaatttccagaatcgtaatgtgatagttttttgtttcaatcgatatatcaccttttgtttccgcgaggatatgctacctttttttaccaacaacatggttaatgtgctgatgaacggtttggccttctcttccaatggctatattgttgaccattaacattactcattataaccgggacacaattaagggccctttgaattggaggaaaaatataggaattttagaggattttaatcctataagaaaatttcctatgatgccctttgaaacaaaggattgaatcctatccaattctttgaaattactatggaatagacattcctatagagattttgaaggaaatttagcaagagctttaacctcttggtaacttttatttgaatctatctctctcatccaatttctgcgtttttcctgcggttgaatcaaacggtcattcctgtgtttttcctgtgttttgcaatcatctgttttacacttacattcctgttgaaatcctacgtttttcctattcctacattttctcaatcctgcgattcaaaggggccctaagtcttggtaccctaggaattggagaaactttaaccaaaattatatgaaatggctacacaaattatattacaaatgctagtactaaatactactagtatactgtaacctccaaaaaaagaagatatacatgacatgtcaaataaaatatatgcacatttatttttataatgcctaggaacaagatgtgggcattaatatgtgttgaattgagaagcatccaaaaacaaggtatccatatctgattatttttcaaggtggcaattaatgcaaacaatccttattctacatacaaattaattaaacatgctcaactctgcactgtataaattaaccatctccactcttctctactccatcaaccagcaaaagtcagttcaattcagttcatcttatctgccatgaaggccaaggttgcagcaacagccctgttcctgctccttctgacctttggtgagtctgatcaactacttcctccgtttcatattataagttatttgacttttttcttagttaaacttttttaaaatttaattaagtttgtagaaaaatataataacattttcaatacaaaacaaacaattatcaaaatttaaatgttagttttaatgaaagtaatttgatattatagatgttactagtttttcctataatttgatcaaacctaaagaactttaactaagaaaaaagttaaatgatttataatatgagatggagtattaaacaaagacatttactaacctaatcatgtttcatttgttgagtacttgtcttctgaattttgattaatttatatattatcaggtggtgaggccaagatatgccatgatcccagccaaaccttcaaggggatgtgcctcagtaacagcaactgcatctccagctgcatctccgaggactagaccggcggctactgcggcggcgtcatagaccgcaagtgcatgtgcaccaaggagtgcgacgacgcgccgccgccgctgccgtcgctgccggcgccgaagagcgggcggcggcgtccgccgccacgggcgccgggggtgacgacgacgatcgaatgaggactgaagagaggctgtgttgtgtgtggtgtgtggtggctattctgattcatgttcaatttaattttcgatcggtcgaagataattaagataatggaattcaaataatggttaataagattgagtgattgaatacctggtgcaatccactgtcatgtttctacttgcaagtagctatgtgtccacgtgtaacacacatttggctgtgtacatccgattggatgtagaggctgggtttatcccattttctaaaaaatgtgtaacacgcatggtgtgatggtgctaagatgaattaaactggatgttttcactgatgataatccaatgcaaaaactaaaggaaaaatttcaaatacgatacccaaagtttgtggtttttaccgtggaaaaaaaacacaactattggacaccctgaaaaactagcaattagctgtgagtcaccctgactatagggcgacgatgactagctacaagcaaagaattaaactgaaaaaattcaaaaaagagagaaaataattaaactgaatttttcatgcaatgagaaaatttatatgcatgagacgtgcctgttgatgtatatgaattgaaacacagaaaaattcaagatatatacgaacaatccatatttctccttttactttccatgacaaaatgacagtgatatataaatatcctattctcatgttaaatcaacaaaataaaatatacctttatgttcgtgtgaggttttcaatcaattttagacaaaacctgcaagctttaaagttcctttaatttaaacctacaagtcacaaagtataccatcacaacttgtggactgagctatttcttgcggtggttcaaattcttagcttgcaacgatgctcgtattttggaggatttaatctcaggaattactacatacacacagaaaggtgtgttcaacaataatcttatgtagacgtgtggactatacatgaaacggatcgaagtaccgtgacaagttgctaattatgatgctcaattgttaaagatttcttggacataggaaaaccttaaccaagaaactagcacgtttattttaaaacattcctacaaaaatcacatccaaattcgtagagcatcaaggcaagttaaagcatattatttttgggcaattttgttgttacccctaatttgatttccaatattgattttatccctattttttaggttttcaattttgctcctgttttttttaaaacgaagctaagttttacccttactttggatggacatgttaacggtgttaaaactttaacgaaaagaaatccatacttttacttgcttgcacatttgacactatttttattcatcaattgtgcccccatttgtacatgcggctcgcagttttgataagcttttacaactatttttttgttggagtaaattacactagcggtccttaaacttgtaacgaagtttcacttaggtctacgaacttgcaaaacacgcatcaaaatccttaaacttggtttagtgtatcattccggtccaaagcctagtttgatcgtggtcttgcctatgtggcatgctacgtggacgatgacatggctaaattttcttttcccctttttttctccccatcttttctcttcttcctcacctcgggtgaagaaaaatgcggcagaagggagaggaaggaggcaaagtggagaaaaaaaaggataagaagggagaaaagaaagaagaagggagaaaaaaataaaaaaaatccatgtcatcgtccacgtagcatgccagtagacaagaccgcgatcaaatgaggatttggaccaagatgatacattaaaccaagtttagggatctcaatgcgcgttttgcaagttcgtggacctaagtgaaacttcgttacaagtttaagtactgctagtgtaatttactctttttgttggctttttccagactataggaaaaaataacaaacaacgaagggtaaaaaatctccgaaaacatgatatgccatatcaaataaaatatatccacatttatgttttcagggctgcatgagttgtgtgaattaaattttgccatttctgcaagtatccaaaattaaagtatgcatatccattttggatgcagggtggccattaataactaatgcaacatcacttgggtgcactcacatttatcaaacatgctatacctctacagtacaaatagccatccatccttctcctcatccaacacatccaattcagctcatggaggcaaaggttgcaaccactgtgttagtcttgctcctcctcacccttggtgagttcactatctactactctctccatcaaaaaaaaaaaatactcgacctagacgggaatgtgacctttcctgtacaacgaatatggacacatctatccagattcgttgagttaggaaatatcacatccccatctagattaagttttgttgggacggcggaagtatacaacacctttatcattgccgatacataaccaacatggctgccaactacagattaaaattggtgtgactaaacagacaatgatactgctaataattaagtatagctataaaattctcataatcatcggcaacctcatatgttgtataatgctacttccaccgattaagcatcatcatcaattgatttatatttgttatttgtgatgagtataggtggtgaggtggctgctgccaagatgtgccatgatcgtagccaaaccttcaaagggatgtgcttccggacctccaactgcaacaccagctgcaccaacgagggctacaccggcggccactgcacaaccttcagacgtcgatgcgtgtgcaccaaggagtgtggaggggacagcccgccgggtgatccgccgccggcgagggcctgatcggggccggagaggatggccggcaatgtggtttctttgattagattgtgtgttacagtgttagtcgtttgtggcagtatggatggaagtcgaataacggattggaaagaacatagttgatgctaatgtgtgcttgcatgtctctttttcaaggtgagaattcatgtaaagaactttaacttttattcgacaataaaaacatccccgatgtgatcacctggaccagaactgaagccggtatcttcaccaccaaaagtgcttataatgcacaattcctgggttcctgctcaaagcctgaatttgacgccatttggaaatcaacagctcagcctaaacagattttccttggatggttaattctccaccagaaaaccctcacagctgaaaatctccttatcaggcattggccatgcgattggatctcatttgttctttgtgcaggcaggcgttcgaagatgctgatcacctcttcagagattacctcttcacgagattggtctggacaagagtggtggagatgagagcaccagatttgcagccccctccaaataacctagccacctgggtccagcatttgcagactgttggagacaaaagactacgaaaaagagaaacctaagtttgctgctcacatcttggtggcacatctggctgcaaaagaatgcaagaattttcaatagtacgacgttaaacccatatcaagtagcaaatctaattgttgaagacatggattttagagaattcacttttaaacctccataagctacctatgtaatctcttgtaataaacctccctctggggaggacaaactctatgctttcctttgttttactcctaatataatcagcagagctcatgctgttttcagcttaaaaaaataaattaattaattaaacatgctcaattctacactactccctccgtaaaaaaaacaacctaagatgattaataagacaatggaattcaaacaatgattaatggggtttgagtgatagaatacttggtgcaatccattatctttattgctagctttgcttagtagtagttagtagccatatgtgcctacgtgtaacttgcatggtttgacggtgctaagatatttggtgatgtatatatatgaattggttcacgaaagtttcaagatatatataaacaaatcctattaggcttttacttatgtatgacaaacatgacaatctcctttgaaaaaaaatggcactgatataaataatccttattctcatgtgaaatgaaaaaaaaaatgctgcctttaggttcgagtaaagttttcagacaatttgcaaactttcaagtaattaatacctttaatcctaaaagttacaaaatattgttgcaagttgtgagctgaattatctcttgtgatgaaactactcactcgagttcaaattctaccactagtacagatccttccatctgtgacggcccataacaagactggaatttacgggccgtcacaaggaagtaatgtcaatcgggccgaagtttcgcccgattgagatatggtcgcacagctatggtatatcggcataaaactaaagcccgtcacggatgacacttatctgtgacgggctatagttgaggcccgattgagatgagggttccatatctcaatcgggccctaaaagaagcccgtcacagatgagggtcatctgtgacgggctccaactagaggcccgattgagataagtttattgcccgtcacagatgacactcttttttgacggccttttattaaggcccgatagagattacttgtatgcccgtcacggttgattgttttagggccgttacagatatttgttgcacagtataaataccccccaccacctagtgtaactatatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcacgtcttacttttgcaatactgatcttataatatgtgcctctaatttgttttttttagcaattgatcgaagttggatgtatgccaaaaatttgaaacgtcattctacggagtaccgaaagggtgtaataaattttatgaacgccacggaggaggatcgaatatgaagaaacagtgattacatgtgttgtccatgtgcagattgcaagaacgagaatatgtttgatagcggagaggacgtacacggtcatctgatacaacgaggattcatggaaggctatacatgttgggtgaagcatggaaagcaagaatcaggaagtggagcagcagcagacagaagtggtgcgcataatcaggaagatgaaaatgagcatgacatgtttataccttctccattgggcggtgaaatggttgatgtggatcacgatctgctgcaagacatgttacgtgacgttgaggacccagcccagaatgagagagatggaatgaaattcagcaggttggtaagtgattccgaaacgcctttgtacgctggatgcaaagcaaaacacactaagttgtcagttaccttggacctaatgaagctgaaggcaagtagtggatggacagacaagagtttcacagatcttttaggaattttgaaggctatgcttcctattgagaacacattgcctgagacgacatacgaagcaaagcaggttctgtgtccactgggttagaggtccgtagaattcacgcttgtcccaacgactacatattataccacaagcaatatgcggacttggatgcttgtcctgtctgcaaggcttctcgatacaagcgaaagaaaagtgctgacgaaggaaataagtcaaagaggggtggtccggcaaagattgtgtggtatctacctatcattgatcgtttcaagagaatctttgccaacccaaacgaagcgaagttagtacgttggcatgccacggaaagaaggaatgatggtatgcttagacacccagcggattcgattgaatggaggaatatagatcgaaaacacaaagactttgctgccgaccctagaaacatgaggatatgtctttgtacggatggcatgaatcctttcggtgtcatgagtagtactcacagcacttggctagttcttattgcgaattataacctcccgcgcgccatggttatgctttaaacggaaatatattatgttgtgcttgttaatccaaggtccaaggcaacccggcaatgatatcgatgtattcctggagcctgttatcgacgatctggagattctttggaaagaaggtgtggaaacttgggatgcatatggtcaggagaacttcaagctaagagttctattgttctgcaccattaatgactaccctgcactcggtaatctttccgaacaaactataaaaggaaagaaggcatgctccgattgcaaggaacatacacgaagccggtggctgaagaaatcatgaaagatggtatacatgggtcaccggaggtggctcccgctacgtcacacatttagaagaaagaagaaaatttttaatggtaagagagaacttcagcctgctcccaaagatttgtccggagatgaggtccacaatatggtcaaggacataagcaatgagtttgggaagaaaagaaaacgtaacaagacaaaggagaagggtatgtggaaaaaaaatccatattttggcggctaccttactggaatgatcttgatgtccgtcattgcattgatctcatgcatgtagaaaagaatatgtgtgagagtttggttggcctgatgttgaatattcccgggaagacaaaggacgggttgaacgcgcgccttgatctacaggacatgaatattcgcagcgaactccagcccatatgagatgcagagacaggtaaagtgtacctcccttcagcctgccacacactgtcgaaggatgagaagatcgcaatgttatcatgcttgaaggatattaaagttccatcgggctattcagcgaggataagtaagtatgttaaattggacgatctaaaacttgttggaatgaagcctcacgattgccacgtgctaatcacacaaatcttgccagttgctatcagatgcattctaccaccgaaagtgcgtcacacgatccaacgtctgtgcgccttcttcaatgcaattggacagaaggttatagatccagaagatctagatgggctgcagaccgatattgtgaataccctctgtcacctggagatgtttttcccactgtctttctttgatataatggttcatctccctgttcatctggtgaagcaaacaaaactatgtggcccggcttttctaagggaaatgtggccgtttgaaaggtacatgggagttctgaagtcgtacgttcgtaacagagctaaacccgaggggagcatcattgaaggttacacgaccgaggaggctattgagttctgtgtcaattacatgtccgatgccgatcctatcggagttccagtgtctcgtcacgagggaaggttgtcaggtgttggcacaatcggaaggaaaagaattaggcccgatcaagcgtcgtacgcgcaggctcattacgctgtgctccaacatatggcagaagttggcccatactttgaggagcacttagcgaaaatccgagatgagaacttggggcgatctgatgcatggattaacagagaacataattctcggttcaacgaatggttcaagaatcgtgtgacaatgtccacggatggcccaaatgagacagtacagttgttggggatgggaccgtcttggaccatagacacatggcaaggatacgatataaatggatacacattttacaccgtcaaacaagatgacaaaagcatagtgcaaaacagcggtgtccgtatagatgcattccaggatcaagttgggtcaaacacatactacggccgcattgaggagatctgggagctaaactacgtcaagttcaaggttcctttgttccgctgccgttgggtgaatctacgcactggtgtcaaagccgacaaggaaggtttcactttagtagatctatctaaggtgggatacgccgatgaaccatttgtacttgcgaaacaggtcgagcagatattctacataaaagacccttcaaacaagaagatgcacatcgtgagggatggaaagcgccgaattgtaggagttgacaacgtcgtcgatgaagaagaatgcaaccataatcttcatgtaagacctcacattgaccttgacgatgatccccaagagcctgtggcatatgctcgttcagatcataccgaaggcataaccttgtgactgatgcatttgtacttatctattgtaatgaatgaagtattttgttttattgtaaagacttgatatgtgtagtcattaatatggctaattttgttttattacaaatgaccaaaataaaagttatagatcgtgatgagaggatcaactttgttgttgaccatatttcaatttgaaatcatctagtatttacaaatgctgttaattagatttgtcatattgtcgaaatcaatttcaagctgttgggaaaaaaaattatatagaataatgaccaaaataaaaatattagatcttgaaaggctctacaactttgttgttgaccatatttccatttaaaatcttttactatccgaaaatgtattatgactaataaaatgaattattacacagctgctatatattttgcactcacaacaaatgaaagatggaaaatgagtcaccggtgacgggccttagtttacggccgatagagattaatctatctcaatcgggctttgccgtagggcccgtcacagatgactcatcggtgacgggctccatactaatgcccgattgagatgacattcaggcccgtcacggatgactcatctgtgacgggccctaagataatgcccgatagagatagattaatctctatcgggcttgaactaaggcccgtcaccgatgactatttttccatttcccagataagtctttatatttgtgagtacaaaatatatagctgctgtataataattcattttattagtcataacacattttcggatagtaaatgatttcaaatcgaaatatggtcaacaacaaaattgatcctctcatcaagatctacaactttaattttggtcatttatctatataactttgtttctaacagcttgaaattgattttgacaatatgacaaatataagcatcatttgtaaatactaaatgatttcaaatggaaatatggtcaacaacaaagttgatcctctcatcaaaatctataacttttattttggttacttcttcatccaacaaagtgatagttatattattcacaaaaatcacatttctctcatctggtttataaatatcaacacagatatgtcaattttgtaaacattggtactatcactttgtcggatgaagaagtgaccaaaataaaagttgtagatcttgattagctgtacaagttagttgtttatggctttcccatttaaagtcatgtaatatttacaaatgctgtttacatttgtcatattgtcaaaatcaatttcaagctgttagaaacaaagttatatagataaatgaccaaaataaaagttgtagatcttgatgagaggatcaattttgttgttgaccatatttcgatttgaaatcatttactatccgaaaatgtgttatgactaataaaataaattattatacaacagctatatattttgtactcacaaatataaagacttatctaggaaatggaaaaatagtcatcggtgacgggccttagttcaagcccgatagagattaatctatctctatcgggcattatcttagggcccgtcacagatgagtcatccgtgacgggcctgaatgtcatctcaatcgggcattagtatggagcccgtcaccgatgagtcatctgtgacgggctctacggcaaagcccgattgagatgactcatcactctaatataactagggtttctcagatcggatcgaaaatttttctaagtcccgctacaatttcccgcctccttagaaccctagcgccgccgccaacttctccttcgccaccgtcgtcctccctcgccaccaccgccaccgagcccgccgccactgccgccgagcccgccgcctccaccgagcccaccgccaccgccatcgagcccgccgccgccgccactgagcctctacaccgaccggcgtcggccttcctcgttgtcgccgcctgcctcttcaccgacacgaacagcagcccccaccaaggccggcgacgtccttcctcatcgtcgtcgcctactcctcaccgacgcccgacgccgccatgaactcctccttcgccgagcccgccgcctgcaccgagcccgccgccgcctccaccgaccggcgacgccctccaccgagcccgccgccgccaccactgagcccccccggccgacctcatgtgagtcctccatcgcgcctccctctgctacctgcatgtggttgataatgaaaatgtggatgctgggatgaaatgtggatgttgggatgaatttagtgattgatgacttgatgatgaatagatggaatgtggtgcattaatgaatttagtgatagatgattttagtgatagatgattttagggattgatgatatatggtaaacgaatgatttttttgattgatgacatgatgatgaatagatggaatgtggtgcattaatcaatttagtgatagatgcatgatatgtggatgaatagatggtatgaggtgaatttatgattttaggatttgatgatatgtttaatttatttatatgtgccattcaattcattctatcattgtgatatgcgcaatttagtttatttatatgtttcattgatttttataagtgacattcaattcattgtaatagattgtagcactcaattgtgttttttttgtttttttggaaaaaagtagacaatgtctcagcaaggcgaaccaatgtcgacgacaactagtgggtcctcaagggcacgtactcctaggacagggaacaaaattcctaaggaacggttccgcataacagcggtggacgccgtagggttaccgacatctccaaggaaaatattgagccgatttaggtctatctgcggggtcatagggaggcaaaaattcagtattctgcaagacgacttcaagctcgtgccggccgcagagaaggacattgcttggctaacgttcaaggagagctttgattatcctgcggagcatgaggaccatctcaggcgggctgctttcaaggttatgggcactgcttggaagaacttcaagactaagctagtcggcgagttcgtctacaacccggcaaatcaagatccaagagagaaatttccttggatcacggaacaggtctggtcggaattccatgcgaagaagtcgacccccgagtccagagctagaagcgaggcatattgcttgctccagaccgggaaccagcatccgcaccggcttggtaccaccggatatgccggtaaggaagaggaatggcagcgtgaggatgaagaagcggaggaatcgtgcacaccgttcgtgtttggcgatatcccacaccctcgggctaggaactgggccagggctaggtaccagaaacatgatgatggcacaatcttcatgccaaatgcaaaagatcaacgagtatatgaagctatagtaagtgtctaatcaaactagatgttcgcattgtttcccatcgtgcagtttatttgaccccactaaattgtaatacagaaggagttggttgccgagcaacaagcctcgcaagaggcctgctctcaaagacgcgaggacgacctcctcacgaaagcattgggcaacaaagaacaccgtggacggacacggggcgttgggtcttctgttccctagaagtatggatttccagactacgcgtggcagtacaagaagcggacttccaacaaggcggagaaagatgcacgccttgaagccaagatccgggagtcgatacgagctgagctgacatctgaattcgacgaaaagctcgagtcgatgagggccaagattaggcaagagatccgagaagagcaacagatcccccaggccgccgctgctgctgcgcacaaagagttaggaagtcccaccgaaaaacgcagcagttgcgcatcaactgagttggcggaaaatccaacatcggtcgacagcgccgtcgacacataacggtaaccgtgaacttactcaatacatgaaagacgtaacgaatccatatgatatataatactctaaaaaaattgattaatctattgtaggaaccaacgagctgcaccctcacagttagggtgatgccgaccttcactgttccagcagccgagggacttgcgtacaagccgaccccagagacaagagtgcatggagcgcaactcagggccgactatgcaaaagttcaagtcgactcggtgaagcccgaatacgagctgttccctctgaagtatccaccgaacgacaaggtcctctcactaggaaatgcccgtggtaccttcatccaatggcccaaggacctcattgagatcagggttacagcgaggccaaccactgcaccaggcggtcgtccaccaaagagacccgcctctgctccttcagcccctcctgctcaagatcgtcatgcacaatcttacgatgtgcagttgcagtacgacacggattttggggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcaggcctcgcttctagctccaagaaagctagatctgggcaagggccaggaagagactaagggcaaagaggtcaagaagaaatatgtcgctccacaggagttccaactaggcatgccattggttggagatgacgtgcttgccgcaatgggcaccgcttgcaaggaccttcacttatactacatggagaaatctaacgccaggaagccaagtaaagctaccgatatccttggacagcacgatggaaagccattccttggtccaacaaattatattgtggtcgacttcaaggatcttttcgacctctacaggctccgagcggtggacacgagcctccttaagtgctactccttgtaagtattgtcgcccaactcattctggtaataacaatcggtttaatttgcttacaagatcattgatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgtgcctataatcaatagtaagtgtgttaactaaatatacacaacagcatgacacattccttaagtacttaattaactttcactatattaatgccgcagtgcccattggatccttctggtcataacacctaaatagagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttcccggtgaagcaacaaataggtgaccagtgcggattccatgtgtgccacaacatgcgacttctgtatagagaaaaggtgaagactttggctgagtttgaggtcggtggtctcaattgtgatagactaactacattttagtacttatatatgatcgatcaactaatctggaattatgacaatgtagggcacaataaccaagtctctgactaccagctttgaggaggttcgcgaggagatagccagcttcatcctccgcgaaataattaaccccaaaggaatgtttaggcttaaactaaaatgatgaacaatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagctggggatattggatatctgtgtttgtttctgtcatttttgcagcgggcatggctagcaaaggcctgaggctagccaaaaaacaaaatttattttttttgtggattatagtcatctgtgacgggccataactaaatgcccgattgagatgagatcatctgtgatgggctctagcttaggcccgattgaggtcagcagtcatctgtgacgggctctaatttagacccgattgagatcatcagtcatctatgacgggctatagtttaggcccgattgagatgagtatcatctgtgacgggctctagtttaggcccgataaaggttagtagtcatctgtgacgggtgctagttgtggcccgatagagataggtcatctgtgacgggctgtagtttgactggtcatctgggtcaaagctatcggtgacgggctttacttagggcccgattgagatatattcattcgtgacggccgtttgcccgattgagataactcttcacatcagtgacttctagcctgtgatggatgttgtgcccgattgagatggggcttaccgtccgattgagatgagggtatccgttctagtgtaaacttaacacaattgctcaaatttttgaggaaatttaattttgggagagagtacatgcacaagtaggtgcttccgataatctcgagtgcgttcaatttatatttgaagtatcattagaagttactaaattatggtgctcgattggtgaacatgactcactgctacataaagacacatggaaattggcactataggtaccacaagtactaaaactgacccctataatttttttcccaccttcacgggctgaaaacacacgaaaaaaaaaccaacacctttaaatgattatacgattataggtgctggttctatagatatggaaagtaccagcacctttaagcggttataggtgttggtactttgatatggatgttaaccaagcaactagcacgtctgtttgaaacatgtctacaaatcatgtccaaactttggttttgatttctggagcatcaaggcacggtaaagaatattattttaggtggatatcttctacacagtatcaccatgttaaattatcaaatgcaaaaatgccaagcatattttgatctccattggcaaattgtagttccatcatatttaccataagaaataaatgtgatatgatctcccaaaacaatatatatatatatatatatatatatatatatatacacaccatatcaaataaattatatccgcatttatatttttcttgggtgcatgcatgagatatgtgcattaaatatttgccacttccaagtattcaaaattaaagcatgcatatccatcttagatgcagggtgacaattaaatgactaagcaacaccctttaggccatcttcaattctcaacgtcatctagtgtccatagcattaaatacacagacatttatgccatacttccacactacaaatagccatccacccttcctcttctcctcatccaacacatccaattcaactcatggaggccaaggttgtagccactgtgttaatcgttctcttcctcacccttggtgagttcactatctgctacacaataatgccttgccattatcactgccaattcacaattagcatgacaacaaactattaattctacagtgactaagcaggcagtgatactgctgagcatcatcatcgattatcagatcatacataagtactaattaccttgtactattcctaatcaagtattgattgatttgtttcatgatttgtgatgagcaggtggtgaggcagctgccaagatatgccatgatcatagccaaaccttcaaagggatgtgcttccatacctccaactgcatcgcctgctgcaccaacgagggatacaccggcggctactgcaaaccatttacatatagatgcatgtgcactaaagattgtggaggggacagtccacctgatgatccaccaccggcgatgccgacatcgccggcggcgacgacgacggtggcctgatcgccggagaggacggcaacatatggttacattgtgtgttagttgtttgtggcaatatgaatcaattggtggaagtctaatgatgaactgaagagaataattggatgttgatgcacatatgttgcaactcaagtttcttggttgaagatagaatggcatgcaatggagaatagtgagatgtgtttgctgaaattgactcttaattaaacatcataaataaacaaagtaaatttgacttaaacatggctcagaaagtgaaaataaatggatgattgaacattaaattgtatggcctagatcgatttaaattagataggggactgacatgtggggctagggggtatttctgacctctcacaccgtatctctctgattcaaccgaaaatgtatattttataagtgtggtgtccaacaacaaatattcacatttcgagagtgtatttcccaaaagattgacttttgtcgtgtcctgaagttaaaactgtaaagtcatagtgacctgtagcaaaatttatcaaaaaaataagttactatagatgtttgattgcataacatggtttgatatataacttgatcaacaaggcactgtagacgttttaaaaaaataacatgattaaaaaaagttatgcttcaaacatctaatagtcattactttttaaaaaaaaaagtagtggggatgatacacagtgaatctactaccatcccaccaccaactccctctgttaaacatccaaaaataaggatgtgtttggttcgtgggatgggtcgggttaggatgcgttggtcctatttttaaggttggagggatgtatggagtgggatgaacccagatgggaatatacctcttagatccaaatccaattagtctgccaaaatcggctgaaccaatcgaacccacttcgacggagcgaattgcgttagcatctcagcgaggatccgctactcctgccgccaccatgggccgcccgtccctcctccgccgcctggccaccggttactgctgctccttcgcgcatgtagtccgctagcccactcaggccattcatctacctcaacgctagtcaatgccgctcgagacagtcgtccgcttgcctgtcagtctacactgcctccttccacctactcgctcgcccgctcgccgagtcaccagccgcgcctctctccacccgctcgtgaagctcctccttatgcctgctcgctcaccagcgcaccactcctccgtccacacacgccgccggtcactcccacactgctcctccttcagccgcccgctattcgccgcccctccttcctctgcgagttgtgagcccctcttctcgtcggccaccaccactcctccacttgcaggtcgccgccagtctccactgctatcctccacgagctgcaatcttcgggttctctctactcgctgggaataaacgtcgtgctaacgtggctccaaacgtaattcatcccatccctgcctcatcccttctaccaaacaaaaaactagaatcaccccgtcctacaaaccaaacaagcaagtagggataatttcatccctaaaatcagggattgtttcatcccatccccatatagtccccaaatcaaacatatgctaagagagcatagggctaaagggctcacctatgacctttacgttgattatattttttttcttctaatacatattttttaaaatttctaataacatatagtcattcaactagtgtctacaaaaatcctttccaaattgtttttcaagttatagagcatcaaagcaagccagcatagtaatttagcttatggagaatcaaggcaggacaacaaatttaggtggctatattctacacaatatcatcatgccaaataataaaaattcaaaaacacggcgaagcatatatgacttccactgaaatgaatagctccatcatatttactataagaaatagataaaagtatgatatccaaaaacaagatatgccatatcaaataaaatatgcccacattaatgttttctagagtgtccaagatgtgtgcattaaatatttgtctcttccaagaatccaaaatgaaggtatatgtgcatatccattttggatgtagagtagcaattaaatgagtaatgcaacacccctaggtgccacacatttatcaaacatgacagtcttccacactacaaatagccatccaacctttcccttcctcctcacccaacccaacacatccaattcagttcatggaaaccaaaattgcatccactgtgttagtcttgctcctcctcacccttggtaagttcactcaccactcaaaatggctttatcactaccggttcataataaaagctgggtatcaccattgattcctggaattcttcccaacctcatatatggtaatgctaattatcttttaaatttgtagttaaaacattgattcatttgtgattttgtgatgagcagatggtgtggcggctgccaagatgtgtcatgatccaagccaaaccttcagaggcttgtgcggccaccccaccaactgcatcgcctgctgcaccaacgagggctacacaggaggctactgcacaactgttagacacaaatgcatgtgcaccaaagcgtgtggaggggagagtccgcctgatgatccgccgtcggcgatgccggcatcgccagtgacgacgacaagagcctgatcgctgaaaatatatatgttgcaatggagaattagtgagatgtacttgctgaaattaatggattgcaaacaataaagaaagatgattcacagtagaattaatggtcttgtataagggagaattcccaaggtcctgatgtgaataaaatcgatgtctatggattgaatgaagtttcaagaaatcttgggacaaatttgtaatatctcaagctttccattaatcatacaccgagaacattcccgtccgaatgcatatgtattgtaaggataaattaaatattacatattataaacctaataaatatcttataacaaactatgctgatgtagaaagcttgtgaagaaatcgtagttttgaaagcatggcacgaatgatctgcacataatccattggagttaatcaaaaaaagaatggaacctagccatcaagagcttcagcttcagcatcagcctatcaccagttaccaacttattaagacaggtttggactttgtactttttcctagctcatcacttatgttatcccaaggtactaaatatgattcacccaagaaccaagaatcaggaagctgaagctctaccaaacgggacctttgagctcataaagatctaactggaacaattgggtcacttcagcccaaaaaaaaaagaagatatgcacactcattctcaaaatatccataagctttgcaaacttatcaccactatccaaaaccaagatggcatatctatgtcttatgcatggtgatgcaatgtgtctaaagtcataaatgccaagactcccataaatataaattagagtaacaaagatatacaattcattttaaaatatcacaacaaaaatatgcacatatatctttctaactccctagcatccaaaaacaagatatgcaaatctgcaaggtagcaagaaatgtaaaacctatttccatgcaagccaaaaccccagcattcatactaccaaaatcgattcaagtcagttcatcttgtttcagccatggaggccaagttgcagctgcagcagccttggccttgctctcctaacctgagtgatctgccaccgatggggatggcactagagaaggcttgagtggacaaaattaagccgcagaagttctggtataagttctatctgtcaacaaaatcctggaataagcacaacaaaagagaaattaagctttatggttcataaatatatacacgagttagcatcgtgtgtaaatcttcagtagaagtatagcttcaccatatatacaggcattagggggtaaaaaaatgtatcgtgtattcatgtacatccacatataggcacctctcatttctactattaagtgaataatgcaaaaaagaaaaagaaaaagaagggggcaaaaaaattcactctacagttatttgtaacagggttgtgagccttggttttctgtatctcctcaaccacagagaggaacatactacactaacagatgagaacgccatgcaagcaccagccagccaaggtggcatttggaggccggtgaatgggaagagtgctccagcagcaaccgggatagcgatgatgttgtacgccatggcaaagaagtagttccatcggattcggctgaacgtcttccttgagaggtcaattgctgtgatgacatcttcaaggttgtttcgcaccagcacatagtccgctgcttcaattgcaatgtctgttcctgcaccaatggccattccgacgtcagctgctgctagggctggggagtcattgatgccatccccaaccattgcaacgacactcccatccttttggagagaacgtacgacatcagcttttcccgcaggcataacctcagctctaacatcctcaatgccaacctgcagacaacaacttcaagctattaggagtttgtttgcatcaaaagataaaataacgatgctacctagcagctgagcagtagtgcagtacaacatgagaatgctaaccaacctcctttgcaactgcttgtgcagtcctccagttgtcccctgtaaccattactggatagatgcccatcttttttaggccttcaacaactacaacagcctcccttttcaagggatcagtcattccaattgagccaatgagttcgctgtcatatgctacaagaactcctgtcttcgcgttcagttcgaggtctaccaagaaactttcagcttcttcaggaatatttatcccattttcagttatcaaagtacgatttcccacctacataaacagttaagcattatcagatttactcacgcatagaaatttataaatcaaacatcagttacttaagagacagtcaaggggtaactgactagctgtatcatattcatatgactcaccaagatttttttcccattgatcaaacactgaacccctttgccaggcaaggcagaaaattctgctacttccagaagccactgggataatatctgttgttttcttttcttgatgtcatcttttgatgaggggagtttgccaaagaaatggaaatgaaatgcgtaatccaatatagcttttgcaagtggatgttcactgcttgcctaaattacaataaaagaacagaataagattacgatgctttcgcttcatttgaaacaagcatacacatacattaatgtaattatcctagggaaatctttgaattacctctgcagatgctaccaaagtaaggaagtctccaagatcaattcctgagaataccttcgtcgatgttacggtagcctttccttgtgtcagtgtcccagttttatcaaatataacatatttcacattctgagccctctccagtgcatctccaccctttacaagtaccccatgattagccccaactccagttgctaccatgacagcagttggcgttgccagaccaagagcacatgggcaggctatcaccacaacagagatggagaacatgagagagaagacaaagcaattgctagtttcatcaacccatgaatttgggtatgctcccaacgatccgcaaagaaacctagagaagtcaacaggcatatgtgagaaacgtgaacactagtaaccacagttctggacttaaacagatgtacaaaacttaccatgcaatgaacgtaaccaaggacaaggtgacaactattggaacaaaaatgccagccacctaaagaatacatgtattgtcagcattttacagcaagtattggtagttgtagcctagtagggatgcatatgtaaagactgaaaagcaaaatgccaattcatggtaaaaaagatgcataaattccacaagtagctggacaatttaattccacaagtactttaatatatattacaatattgcatagataataagttactctgtaagacttcataaagtatcaaccatgcattccaggtaacaaaggaagtgggaagtgatgtattgagatcccgtcaagggaaatgtaatttcctccataaggcacttatgaacctaactacataagttgccccgaaacaatttttacggatttaagatttgaatagagaaaaaattattttctcggaaaccttgaatagaaagatgtactcacataatcagcgaacttctgaataggagccttagacatctgggcagtttcaacaagagagattatctggctcaagactgtccctgatcctactttagttgcttgtatatggaggattccatgtaaattcattgtgcctccaattactatactggatacttccttggagataggtgcagattcaccagttaccatactctcatcaacatgacttgtaccccaaacaacagtaccatcagcaggtaccttggaacctgggagcactttcaagacatctccaggttggattaaggatgcatcaatctccttctctgcagcatactttccttctatattcaaggatagtattatgagttggtacatttgcgaaagtctactagtatgaaaatgccttaagagtatgtgtgcatcattgcaattctaagaaatcggttaagatacaataccaagccaaaaaagaaatactatttgaagataatttggaaatgagctttctgaaattgctactaccataatatgaatttgttacctttgtctttcagaagcaaaagtgctgtagcagggaccagctctacaagcttcttaatagcgtctgatgttctgcctttagcaagcacctcaagatatttcccaaatagcacaaatgtgattatcatggcacttgtctcaaaatatttcgggggatgaaatccagtgaatgcaccataaagaagcgcacatacagagtagacgtatgatgcagtggtgccaagaacaactagtacatccatatttgtagagccatgtctcagggccctataggctgcaacatagaatcgtttgccaacaccaaactgtactatactcaccagtatccacttcaacaagtctcctatataaaatggtcccaagtgcatgagtaggagggaacgagtgaagtgtatgcgagggcataccatgcgaataaaaaatacaggaatctgttgtaagggaaccagaggagagtcagtatgctagtagcaggacataactcatgttaagttaatttcatatcagtgagaatatggcatatggaaattgtatcagataacactgacatgttagatgggccagctatttatatttacatctacagttatgacaaggctaagggcctgtttggcacagctccagctccacctctcctggagctgtagctcagccaaacagtttcagctccacctaaaatgggagcggagctaggtggagctctttgtgaactagagaggtagagctggtttaggcagctctataacttcactccagacccaactcctggagctaaatttagtagttggagctctaccaaacaggcccctaactattagcagaaaatatacattgaagtactcactagaaatatgaggagaatcagaaacctcttgggaagcaggacaaacaaacttacgcttaggaataagctagagcaaagaagatgaagcattttggaggcctcctgtgcatcatttgaagcagcccgtatgtaaggattctgtacatgggctttcagtctgccactgctttccatctcgatggtatccacaattgacctcaaaccaacaacttctggatcaaatacaatttcagcttccgagagtaccaaatttacgttgaactgacgcaagccttccattttttttaggatatcatgcaatatatctacatctacctcagtatgcaatcccattaagcctagcaaaaccttgtcttgttcactactttgtaacagtgcagcttcaaaaccagcatcctcaatagcctgaacaatttcatctttgctgatgacagaaggatcgtattcaacttcccctaatgaggtcgctaatgcaacaacagctcttttaacaccaggcaatttcttcaagataccctcaacagaattcacacatgcagcgcatgtcatcccccctatcctaaattgtccagataaagtgttctgcagcttgggctgagaaacagtagagtccgggagtagttctgcctcgaatccagcatcttctattgcttctatgatgtcttcttcctgcatgttccaacatggaatcaattgactggatgcatacatcttaataaaacagtccctttcaggacctttccgatacttaaagtaaaagcaaattagttgaaaaaaaaaaagctcgcagataggtaacagagcaaacagttggagtattttaaaggaccgaacatctacctacattgtagggagactgtttgcaattgcaagtttccaagttacaacactgtatcaaacaggattaatcatgaactggttgaatcacagtgaacaatgtccctatgtcataatggtgactgttgcaaagtctgctgcgccttcacagttgatactacacaaatcgccctattttcccataaaaatagacgtaatcccaatagttatcaacctcagtagagttccccccctccccccaaacacagcagcagcagctataaaaaaaatcaccataatattacgcatcctaccagctcagcttatcatttcgggttgaagtatttgaatcactagcttgatattgcacaaatcccacccaaaaaaaaatcgaaccagctctcgaattttcccatttggaacgaccttccaaatctaaaccaccctaactgacaacgaacgaaaacgaagctgaatttcccgcctcgagaaggaatcgattccgcggctcatctatcaccaacccaaatccccccagtccgagaaatccatccaccgcgacgcgctacaagggggacgcgatcccaaatcagagccccgcgcgcgcgcgcgcgacgcgagagagggaagggaagggatcgcggcgtgggggggtcaccttggcgagcgcggggtcgaagacgacgcgggcgcggctctggaggagcgagacggcgaccccgcccacgccacggcgggcggagacggcggcctcgacggcggcggtgcaggcggagcacgtcatgcccgtgacccgcacctgcacccgccgcatcccctcctcctcctccggccccggcgccgccgccgcctcctcgtcgtaggattcggggccgagcagcgcgacctcctccatctcgtcggcgccgccgcggccgccgccggcggcgagcggcgtgagctggagatgggccatggatgtcagagacggaggcggcaataattaggggaaggggaatgggaaggccaggaatatgggggagaatggtgggcgtatttgtataataatcccagaaacgaggggggtttcaggtaaatttgagggatttgagggttttttttttttgcaaatttcgcagttgtaaacgtttttgttttgtgggttggtaggcagcatctggcaaactgtcaaaattagagaattactttgtctaatgacttcttaaccctggaggcttggactaattttaagaacaggtacaatagcagactattaaccagctacaaacatattttaataagataaaatatgagagagaagagcaacgggctacagatctgaaagtaccttaatgtcgtctagagaggggtgaataggcgtttctaaaaattatcacaacttcatagcatattagaatgatgagaactttcggttcaaataggaacttccgatatgagattggaagttccggtctcaaccgaaaagttcggcggataatggaataaaacactagctatgaacttgtagctcaaataaagaaaatgtatatgaatcaaaaggtgacaaataaggtatctaaacaagatataaggtcaccaactaaatcaattaagcatgcaagtagatcgggtaaaaacaagctcatgtacaatataagagaatgcataaatgggcaaaccaagagaggagacacgtgatttgtttcccgaagttcggatccacgaatcctacatctccgttgaggagccacaagggccgggcctatttcaaccatttcctcacgaggttgcacaaatgcactcctcggtttcactcttgatttcttcccttacggaggcgaaattgaagccttcacaaactttccgtggcacaccacaaccttgggtgctcaccggcgacgcctagccgtctaggagaccttagtccccaagagtaacaaacacaatcgaagatttgcttgctatgaactcgagtgctcagagtatggagtgaagctcactagctctcaacttctcaatctctcaatccaactctctccccttctcaaatctctctcacaagaggcaccacaaaggatggagtgaagctcactagctctcaactcttcactctctcaatccaactctcttcctttctcaaatccccatcacaaagaggcaccacaaaggatgggaaaggggatggctatttgggtttggatgtgtctaatgttgcccaagaacaccagccactcaaaggaggggtggagtagtttatatacctgagcctctcaaaaactagccggtcgaggccaagcctgtaattttcggattttccgaaaagcattttcggacaagcccaaaaatctacagaagcaaatctcagattcgcagccattttcagaatgtccgaaaattttcgaagttatccgaaaaattttcagagtttccgataatttttcggactttccgaaaagcacagagtaaaacgactataacttttcgctcgggagtccctttttgatgagcttggactctatggaaagctcactcagaggactacccaactcaaccaaaaacaaggtctaaaaccactcaaaggataggttaaagcttgggtttctctcaaggtagcactatgatatgtcactttgagcaccgagacatacacaaacacctcgacgttgcatccctattaatagtacggcatttctaaactcaaatgtaaataagaagataattataccattaggaatgccttttttatttttctttcattgttttgagggacgccaatgccgataccgtttcaccatatattcttcaaatgattgatgcggttacttgtagcttcaaatggtctcgcacggtccatcatgacaaagccgtcactcgcccttcaccaccggatttggttcttcggcgccaagccccttgcttacccttcaccgccgcatggtccatcgctaccgagcatcacttacccttcaccgtcttgccataatagccacttcgtatcacacatcttcaatatcttcactttgtcattcttggtattgttaggtataatgatatcacttgagcatcaacacatttgtaatccttgggacctatttctttcattcaactcaataaaaatattagtcccaatgatccggttgtgaacctccacatgttgaccaaccgatcgcatgtataaaaggatatgaataaatgatgagtattaatcaataccacaagtgtcatatactcaaatatatgttcaaatgtaaagatcccaattaaatgaaggtgaataacttggatcgattacatgcataactaaagtataggatttgctccccctaaatgtatgcatacaaaatatttgtgtgaagcaagagtatgcataacaagacattaaatattgagagctcatcctatacaagaatagaaggcatttatcaaatatagacaataaaataaaaacataccttcatcatctccatgttctcaatgtaaagagactaaacaagatatggctcaaacaaaacattagtctcacatgcttatgtaatcacatgaaaatattatatatgaatatatcaatatgtgcacggatagaaagagagatacatatagcttgatctccatgcaattcatccttgtgatttaggtacaccatcaatgaacgtttctctctcaactcatatgaagtccagaaatcacctctcacatattccactttcatatccatatgagactagtagacaaagaaatgcttataataatgttagtctcatgtaattggatttgtcattaatcatcaaaaccaaattaacggcactcgaactttcaagatctgtagccagctataacacagacttcaagacgcaaatgtgtgtatgataggtgggaccatatattaataatatagtaaacaattagtatgaattggctattagattagttatagatgaattggagctagtagtgggctatactattaaacttgctctaaggtgactttgtagtttcttatggtttatcaaccgacgcttctacataagctattaatttcattgccatctacaatcctatcaatttctggatacttgtacccacttggtatctataacgtataaaaaaaattacttagttagtcataagtaaagaaattttacttattatatttttttacttgtatctacaagtgactcaatcttccgtttgcaaattttatttgttttttactcaattgttggctcttatgttaattttattcctatccgctatgtatcttctactctctccgtttcacaatttaagtcattctgtcatttcccacattcatattgatgttgatgtagattcatcaacatcaatatgaatatgggaaatgctaaaatgacttacattgtgaaacggaggaagtatttaattattgtaacaatgctatctatgatgttgcaaattaatgtggtattctgatgtgtgtattacttttttcccatttatccgccaagggtgtgtttagttcacgccaaaattggaagttttgttgaaattgaaacgatgtgaaggaaaagttaaaaatttatatgtgtagaaaagttttgatgcgatggaaaaggtataagtttaaagaaaaagttgggaactaaaccgggcccaattgactatcttcatttttttcatattaaaatcccctaaatacttcaagaaaatactcaggaactcatgaacattctaactaattccacaaggtggagggttagtcgggctgggttcgaaatctcatctattctattaatttgaaattaggttattttataatattggccttcttttttttaaaaaaaaaggttgtgctttcaattcgcttccattgtcaaggggccgggatgggttggtggcttggtgcccgacaacgtggataacacgaccacttttgcacatcagtcccctcaccttgggcccaattcgtttcttgccccctagaaaaccctttttttagatgatgagagaatcgatcagtacagtgccgtataatatgaaatttagttaatcagcagctttgtagtagtactgcatgataatcgtacgatgatgatggcgtcatttgcaaggattaacgagaggtaccggtcatgctggcgaagaagaaaagagaaaatggagaaattgtcaacgaggcgtgacgtgcaaggcagaaaattttggccatcaacgaacagacacgagcataggccgactttagtttcaaactttttcaacaaatttttaacttttccatcacagcaaaacttttctacacacataaatttttaacttttccgccacatcattccaatttcaacaaacttttaattttgatgtaaaaaacacaccaatagttaagtgcaattacacatactatggagcaagttatacatgtaagtgctacgtcctggaagtgttattacaagtagtattatttagcaagttttctactcaagtattccattattggttgcgcgcgtgggtaggggtgtaagtggctaacccgtgaaacccacttataggctaaaataaaccgcaaacccgcttattttgatctataagtgggttcgcggctgacccacttacagccctacgcgtgggtaatagggtgtgttcgccagaagcggttcccaaccgatacagtaaatacggaaaacggagcgatccattaacgcgtgattaattaagtattagctattttttaaaaaaaaatagattaatttgattttttaaagcaactttgatatagaaacttttaaaaaaaaaatgtaccgtttagcagtttgaaaagcgtgcgtgcggaaaacgagggagaggagttgggaaaagggccatccgaactcacctaaggccatgtttgattcagcttatgattattataatctggattattaggagtaagctgaaacaaacaagtatattattataatctataaaccagattattataattcaataatctcctctagaggagctttttccatattattgagtggctaaagacccactacccttagatgcatctaataatttagagaaacaaacaactcgtagcttattttatgttagcttattataatccagtatagagtaatctgatttaataatttagattacaataatgttaaggtgaaacaaccaggcctaagtgtagttaaaagtagatactggaaataatccggggtgatattctaattagttttcttttttttattaagttgcgattgtgtaaatttcattcgtccgtccataacttctataataatggaatgttattaagaagaaaatactagtaatttgagtagtgctattacatatatgtgcattgataaatgcagaggccagaaattaatttggcccatcttgtatttatctaaaagaagaaagaaagaaaatagtaacgcggcaaaatagcagtaggtactagtagatgtttgcatggacatggcttttgggaatttgggaagaaagcaaagcatgtagtacaaggttgtacgctctgtactgcaattttgttggaaacggtcacgagtgtactactacacaccacaccgcagatccatcgcatgttccacctgcttctagtagtaaccttaagcatggatcatcatcattgtctggtatctaatagttagagcagttacattagcaggctataagctagctataaacatattttaaagagataaaagcgaagagagaagagcaacgagctacagatttgtaaccagctgtagtatggattttaagacgcagtatgtgtttgacatgtgagaccagatattaatagtgtagtatgtacctattgtatgaattagctattaagttaactataaatgatttataagctatactattaaacttgctctaagtataatctaccatgccgttaaaattaccaaaactaccaatattatcagcaacatatatacatgtgttagtgttattgttatattttttatagcaaactaaacaccaccgagatactgtttcaaggctgcgttgtaatgagttattttcctcatttttcattagcacgttttctaaagtgataaacagtgtgcttgctgtgaaatttttttatatcatagtttattttaaaaaattaaacaagtatgcttttcaagtttataataattaacacttaatttatcatattataattacttttctcgtttttgtgggctttgtgataaactcatccaaacctccacatatcgaatagagtggcaataatttgatacggcacagttagttagttttcttaaagaaaagtatgggactaagagcaaggttaacagtatagctatcaactagcttcaatttatctatatccaatctaatagtgaattcatacaatagttgcttactatactattagtatatggtcccacatgtcatatacacattacgtcttggagtccgtgctgcagttggctatagatctgtagcccactactctctctcttatcttttatcttattaaaatatgctggctaatagtctactattgtagtaccaacataaaaagtgtgcagtaatctagctaggagtaaatgacagatggtaagcccacggtataatgggcctaacgagtttctagccggaaaggtccacttttggtcccttaaccacaaagttatacaacatcctccactatcaaaagcaagtgcaaatcgaacatgtagtggtgtagaagacggtttcgttctacgtgagtttgtccatctatatctaataggtcaattaaatgggtggttcattatataatttttattatattaactagcacaaatacaatagttttaatctcgatcaattttttagttggtccatggaccacagtgccacctagctagctacgacactgcctacatgacacccacatgatactttatcttgatcttcataccatgtcgcacatatgtaacactagaaaaactataaaaaatgaaaaactcaataggacccacctgtcagtcggccatctctcctctccatccccctctcgtgaacagcctacccgttctcctacaaacagcacggcgaagtcattgccgttacacagagacgcacggagccatacacacgacacacgaatcagcttctccgatgggaccgataggaaggcaataatattttgttaaggaaaaaaaaagctaaatcggaggtagcaaaagagtgaaacacccagtgggtctatcggctggctatataaagtggtggactagacgatttagattagagtatttgatattagttccttccctaatattcgtctctttttaatgccatccacatggcaccatctgtgcagtccaggcagggaagagatgaggcatatgcgtgtcgctgaatgtgggccctttgcatttttatttatttatcctaactgaaatgccacgtaggcagccaccagggacatctggttttaataatctggagccccgaatcttgagtaaagtccatcaccagtctctaaacttctaaacttgtaccgctgtatcatcccagtccctaaactcgcaaatcgaccgttcaagtcctcaaacttgttcgactgtgtcatcccggtacctaaacttgcagatcactcgtttagttcctccaacttgttcagttgtgtcaccccggtccctaaataggacggtctaaaaactttatattaaaaaataatttataacttttttatgtgaactctaatgaagacaaactttatatcaaaactgtagccctcgacgcgacctacaactttgtagttgaaaagtttttgaattaaaactgtttatggtcccaaaatattgttgcatgtttatagattttgaaattttaattttaaaattacattttgggacaaaaaatgacttaaaataaaaaaaatcaattacaaagttgtagatcgtgtcgaggactacaagtttgatataaagtttatcttcattagagttcacatgaaaaggttatgaattatttttaaatataaagtctttagaccatcctatttgacccagatgatattcatattcaagtttagggatcggggtgacacaactgaacaaattggagtacgtaaacgagtgatctgtaagtttagggaccgagatgacacaatcgaacaagtttgaggacctgaacggtcgatttgcgagtttagggaccaggatgacacaacggtacgagtttagggcccggtgatggacttcactcccaaaatcttggggctatagttgggggatgaataataaacttcttcctttctggcccgtgcagcatttcaggcccagcccaccaaggcccaatagtgcagagccttactcccacatccggcctgcgagaacgcatcctgttcgtgcatccttccgctcgttgtgtgcagcaaggcatggccggatcattcaagcttcatatgtaagagtgtcagattactgaaaccttccgtataaaaatgaatcaacttttaaagaaaaatatgaaaacacttgtttagattcatcatcataagttgattttttccgaggatgaaaaaaagtagatgtttgtgtgcgtgctcggattcagagattgaaagaaacaaccctttcttttctcacgataacattcacaaattcaaaagtctctgtttgttttttcttttaagaaaatggattaaatcagtcactacatccaaaatagatgtacacagccaaattacgtacctactactacaattcactttggatttcagaactactccctccgttccaaaaaaaaaaaaaaagataaaccctggttttcgtgtccaacgtttgactgttcatcttatttgaaaaaattatgaaaaaaattaaaaagataagtcacgcataaagtattaatcatgttttatcatctaacaataataaaatactaattataaaagaatttcatataaaacgaaacggacagtcaaacgttggcacggaaacccagggtttactcttttttttgggacggagagattacctactatcctactgtgaagatgctcatagggatagggttgcgtgcgtgtgttcatagggggtgagtgcgcgtgcgttgtgagtgtctgcgttgtattgtaattctaaaaaaaacatgaacccatcaacaaaaactataagaaaccaaatgcgtttactgcaaaagcaaacaataccaggtggataggatcccaaggccgagtttagttctaaacttttttttcaaacttttaactttttcatcacatcaaaacttttctacacacataaactttcaacttttccatcacatattttaattttaaccaaatttctaattttggcgtgaaaacacaccccaatttgatcgccgttgcgttgctgggtgcgggtgggtgccagtgagcatggtcaaaagacaggaataccggacctgcagtggtacgtgcaggcagtcagagctatgttagctggggtaacagctttcatgccgaaagtttggatagtttttggcaaactgcatgacatggatgcatggatggacatgatcgatggatccatggacgtgacagatgagataattggcactcatgctacacagtaaatactcctttactttgtgttttgaggagtatcaaactatcaattagtggtgcaatcgtgtgtttcgaggacttgaggaagatagatctggatggcatatctcgtattaaattaacttattttaaattgatggaagtagtaagcacccgtgtgtgccaagacgaacgcaatgcatcgtggaagaatgggaccccctatgaagagggattaggctgtgttcgggaggcatggttgccaaccttgccttccgacgaaaaacaaagcacgtgattatagtgagattaattaagtattagcaaaaaaaacttgaaaagtggattaatatgattttttaaaataactttcatataattttttttataaaaaatacaccatttagtaatttgaaaagcgtacgtgcttataacgagagaggtgggttgggaaagaagggataagaacacagccttaataattgactagagtacgagaaaggcaacaagcatgcacgttctcccgtccctttctttgttcaatttttccttctcaacatcgagtatacacatacacgacctgtcgattagtccatcttcctacagcatagataggtctcccatcgttggcctcatatctatggccatcttggtctttgacaagggaagaaaagaacataagcatgcatgtttgaaggagctcgacgttcgaagtaggtaacgagaatataaaaacattgacttctctaacttctgtctactagtttattttatttacttcataataattactatatacatttgtatcttttaatagttatcacaaaatcatttggttatttagtcattaagctatttaaaaaggctatatagtatcacaggcctacttcttccgtcccataaaaaatcagtctagtaacggatatgatacgaatctggataggcatttattcacattcatagtaatcatagtaatcagacttcttcatttaaatggaatcagacagtagtacaatctccattctcttttgatgggtttgttccatttcaattatgatgaataattacatagccctaaaatctcccgtcccttcaaatctgaaaacgaccgacttgagatgattggctccgtaattggactctggacgaggtctcgtgtgagctatgacaacatctgatattcaaacaccaaaactcgtgatattcgaaaaggaaaatcgtgatatactccctcctttatttttcaaaaatactaatgcatgtttgcaacatgattttagagaaatgcggacaaatgttttattgggtttaggtttcctctaattggtttgttccgatgggttgatttttcgtgggaataccttttttttgtggattattttatctttcttttttacatgaggagatataatggaaaagaggagaacggcttcgtttttatggtagtagagatagttacgtgtaacatttgataaattttatcctaaaatatagctgtacttccaaagtactaaggtatgatcgtagtgctaataaaaaaataagaaggaaagattgtagtgatagaatatccaaaatacccccctcatatctctatagtttttcagaacatacatatgcatttctgctcatcagtcatcaccatgaacacaaccaatcctgcaaaccgcaaaactaccatcaatagttcgatctactcctgtcttatgcatgccttcaaagcttgtttaggccttatttagtttcaaactttttcttcaaacttttaacttttccatcacatcaaaacttttctacacacataaacttttcaactttttcatcacatcgtttcaatttcaaccaaactttcaattttggcataaactaaacacacccttagtagtgttggagtattatctgctcctatctatgaaatctatcaatcggttctccgctacagttcaacaagagtagatggaaggacgaccatgtaaaacaatgggagaaaaagagagagagcagaggatggtagtggtacactagtactactccccaattatgtcatttttattttaaaaaataaggaaataccacaaagacatgtgatggtataaatggtggtatatgaaagaataaagtactacaaaatttagtgtgtgggaggataaaatagtataagggcatctttgaatcaaaggatttatgtaggaattttataggatttaaatcctataggaaattttcctatttggccctttgattcaaaggattgaagctttccaaatcctatgaaattcctatggaatggcacattgcatgtggattttggaggaaatttagcaagagctccaacctcttggaaaatttccttttagtctatctctctcattcgattcctgtgtttttcctgcgctccaatcaaacgaccattcctatgtttttcctgtgttttgcaatcctctattttacacttcaattcctgtcagaatcctatgtttttcctattcctccgttttttctaccctgtgattcaaaggggccctaaaagtggatggtggagaataaactagtactataaaactagtagaataaacattgtctcaaattataaaatcctttatattttgaaacaaatttgaaggggggagtaccatggttgagaaaaagcaacaataaaagcttaggattcatggctacatgcaaatatgcatgcagttcttctcctactcttgcagtgatgatgatgagtgatgaggcaacaaggggaaaatattgtagtactagtgtactactactatcttggtctcttggagctggatgcatgcaaagcaaaggattcagatttgcagtgagcagatgagttgaattgcaatgagatggggggaagaaagctgaagtgggttctgaactttctgaaatttgttagccataggaggattgggacttgtagggagccagctatgcatttccttgtcctagctatagctagctgctccttctatggcatagtggtactagtagttgtcataccgaggaagtggattggaactggagcatgaaaaaatatcgagtgtgaatgtgagcattttagaaaggacaaaaatatttgcaccgtgtttagttccaaagtttttcttcaaacttctaacttttctatcacatcgatcaaaacttaactttcaacttttccgtcgcatcgttccaatttcaaccaaacttctaattttggtgtgaactaaacacaaccagaaagttttgaatttgtttccacgcatggatatccaagtaagggtgtgtttactttacgtcaaattttaaagtttaattgaaattaaaacgatgtgatgaatagttagaagtttgtgtgtgtaggaaagttttgatgtgatgaaaaagttgaaagttttaaaaaaaaattgggaactaaaccaagcctaaaaattggagtagtatgcatcaccaccatcaaagattcctcaaattgaattgaaaacaattgtcttgtctttatttgtttttatgtctcatcgtaacaattgtacacatatcatggttgattggagaatacaagtaaacaaacacggaatttttttttgttatatccactcaacctacgatcaggttacatcatgtttgaacaatataaactggcaataaaaaacagagacaatacaaatgacaacaacaatataacacttcgatcacatccacatatccgctatactctcgatcgatccttataaaagtatcaccaagatattacgtataatctccctccaaattttttaggtttcctaaactgaaaatagaaaataaatgatctctctaaaagaaagtctaaattttatcaaaaaactaaaagtgggtccttctgttaaactaccaacataattctccgttattctcggtgcgcatggagaatatatcgtgctcctctaagacgggatgtgttggacccaattttttttctaaaatctcttaaaattagttttgaaaaaaatatagattttaacaaaaaaatataggatacctattggtgatgctctaagagcaataggccttattttaaagccctaaaagttaaatgagggctgcccccatctcccaaggatccaaaaaatacctccaactctagcaatagcccctatttcttagcccctactcatgtttctattttattttaacatgcaatccatgtttacactatgtttaacaccacaataattaaacataaatatttctaacgcgtataatttaaccatagttaaatttacaatttcaaacgccacaattcaaatccaaaatcaaaattttcaaacatgtaaatatggtgtgggcacaataccatatacaataacacacaaccaagatttataattcaccaatgaaaacgaaaattgctcaccaacatgtgtagctcaggaaattaaacagcaatacacctataccctctagaatacgatcacaagatttcagtaatagaaaggtgaggagctttgcccaaaaccatattagctcgatccatgcattccccctgccaatttcagttatagtactgattctctgctgagttgtgatattgtcgatttttattatgatcactaaaatataacaaagtgcccaccaccggattctttctcaccaattcattcacatgatcagttcgggcataattaaccacctatcttatagaatttccctactaatatctgaactgaacagaaatttccacatgcttatctctgaacagaccaaaaatttggctccaacaagagatttctaaatacacacatccaatttatctcccacaagctaaatctcaacaaagaacaaatcttatctaattgcatccacaaattcattggaaaaaaaataccttcgactattgccggccggggagaagggcgccggatgtggaggtggtttaccaggaggaggccgccctgcagggaagtggctggtagggcaggagggtgccaggaaggaggccaccgggtgggaaggtggccgacaggggaggagatcgctagccaaggaggtgatccaccggggaggagtgcagcgaggaaggaggtggccactggctagtcgggagaggacggcgctgatcaggcggcgcacatgcaaggagaggatttagcggcggcgctagcaaaagtttcgcgcgaaaaaagaaaacaacgcgcggatgtgggagatctctcccgcgtgtggaataggagccagcgagaaagcccgtaggcctgggggcttgaggggataatttggaggccttcctattttaggggcttaagtaggggctttgttagacctgatttttttctctcaaccctcaaaacttgtttaggggctttgtttaggtcccctgctggagatgctctaacctctcacacaaaaaccaccatctactctcaaattacaatggacatatagccgatcgcgaaaaccgccctcctaatcccatcatccacacccaataccgctattgacccacacacacccaagtatccccaatcatccccacaagggagaggatgacatgtatgccaatcccatgccaacaagccaatgagaaaacatatagctcatcaaggttttgcatgtatataggaaacaagaacacctccaaaaccaaaccaaccccagcactttgtaccacccatcatcacacccccaaaactcatatatccttcacacaaacacatactccctccgtcccaaaaaaaaaagtaaaccatgagtttccgtgtccaactttgactgtccatcttatatgaaatttttttataattcgtatttttattgttgttagatgataaaatatgattaatattttatgcgtgacttgtctttttaatatttttcgtaattttttcaaataagacgaatggtgaaacgttgaacacgaaaatcaggtttgtctttttttcggaagggtggagtatatccctctctctctctataaataccctcctccatggattcgttaccacattctcctctctctctctccctctctcatccatttcaattctctctcttgacacagctacaagacaagccacctcctccctccctcctctactgaaccaagaagaggagagagaaagtagaggagagggagacaagcagacagacagaattgcctgccaagaaacgagatacacacacatctagagagagaaagtagagagagatcaagaacaagaacaagatcaagaagaggagatctgtggcgatggggatgaggccgggttgggtaggcgggctggtggaggagagcttcttcgtgggttgcccagcgcacgagagccggaagaagaacgagaagaacatcttctgcctcgcctgctgcaccagcatctgccctcactgcgccccctcccatcgccaccaccctctcctccaggtttcactaattaatccccctcccccctccttaattctcccctcccatcgcttaatcacgcatgaatcaagaaccatcatccacccagttctttgtcttcttgttgctcacttctttgcatgcatggtctgattttcttgaaaaaggaatggagtgtgtgtgttttttttacctgttcatgcttgaattaattagtcttttcttggagatttggtaggaggagtgaattgatcgattgattatgagctactaatgagagagatagtagtagaggccaagaggagggggtggtgtgtatcttgctttttgttttgtcctgtgctgtcttttcaagtgctgttcctttcctcacctttcttgttctcttctctccccctggattgattagattttggattaagactttgaacactttttgttgatttgcatactagtgggatgatgatgatgcttctcctctcttttgggattatatgtgttattattatttgctaatcttggatgtacttttgcttggttcttcaccattgtcgtcttgtgagcttttggggggttaattctgccaccatttgaggccttgaatttaggggggttgttcatgatgttgattgcgtcctgtaattagccacactcacaatctgatttgtgcaacaatttccatataaacttcgtggataattcttggttctactaatacaccttccttgatctttggcactagatgtagtaatttaattgtggttaaaactgacctaggtaactcattgtgtgggtgaaaggtgggagtagtatagaaattaattgtgattgagattctcttgttgcattacatgcaaatatgcaagagcaaatctgcttcatttaatttgttccttcaatttttttttgccttcaatttgttccttcaattcggatttgtcctcttcctgccacttcctttccctgcatgcatttcattcaactaactcgggtcagtaaaatttgttgggggtgaggtgagtagtaataactccgatgtgaagaggtttgggggataaaaaagctgtgtgagtttttactgcttcacctttggccttacacttgaaatgggcatagtgccatagccttttcacatgttgaattcttctttttcttgtgtcaatttacctacaaagttactagtagtacaagtcacttcaattttcaaaaaattggcaaaaactgattaggtataattgtactaacagtggcaaacaaattctgaaaaagaatcatctgatggggggggggggtttaggagatttcctttaataggccaggttatccaaaatgtcttgccatgaatagatagaaacacacactctctcatagagaatccctgatcccttactgcctctgcaaagcaatgtgtggtggtaaaaaaaaattaaagaaaagaaatggggataatatggcatcatcttagaattgttactgccagaatttaccatatgtgtgtggtgtggtaaattggcgaccttgtctttttttaccaaagaaaggctcaacactgttgttaccccctgcaactgcaaccgtccagtgggccccaccccctccctctgctggctgatactgttcatcaaagccacagtgaactaaccagtgacctcctcctcccaaaattttcttttcatatctcaaaatttttctttcttttcactgctccatatccattggctggttgtgcttcgttgaggatttgacgtttctgccctttggttctgggattattgagctgcacggggcaggggcatttcggtcattttggcaacccccctcccggtcaaagcatggccctgctttcgtacgtactaccagctgcagcagcgtcctattagaagagcctagcgaagtgttagcagtagctgcacgaatcttaaagcacccggatggcctaatcggacggtgttggtgttccccacaggtgcggcggtacgtgtacaatgacgtcgtccgcctcggcgacctcgagaagctcatcgaatgctcctacgtccaggtgattagctactgatcactacttctaattaatcactcatgttccatgtaaattactccctttgtctccaaaaaataacggattttggaaggacgagatatttcctaatactacgaatctaaacaggctcttgtattattagaaagtgtcacatccctccaaaatttcttatattatactaatgatgtcgaagtaggatagagggagtacgttgattagtgatgtgctaatgatctgtaattaacgtactaatgtgggtgcagccgtacacgatcaacagcgcgaaggtgatattcctgaagccgaggccgcagtcgaggccgttcaaggggtcaggcaatgtgtgcctcacctgcgaccgcatcctgcaggagcccttccacttctgctccctctcctgcaaggtggaccacgtcatggtccacggtggcggcgacctctccaacatcatcctcctccacccccaccaccaccccaacaccgccaccgcctcggccttcccccgtttcgaggacctccgtgtcggcgctgacgatgatgctgccgctatcaccgccgtcacgccagaaggacgttatggtggcggcggtggtgggtctagtgataatggcggcggtgatggcggtggcggcgaggtgggggaggtgaagaggaagaagaagaaggggggagggttcttcccccagattctggggctggggagtaggaggaagggtgcaccccacagatcacccctgtcctaagcctaatcaccactttgcccccctagctacatatatgtgccattaatagcagctagctgttaattaattactagtagtagctaagctagcccctagctgtactagctagttctagcttttagtgtgtcatgtcattatagccctatgattagccatgtagagagagatgagtgtgtgtgttaatttgtgtgttggttggttggttggatgggttctttgggaggtaggggcttttgtttgtgtgatctagcttagcttaaggttaattagcttagctagggccacttccaagctaataggcacttaggcagtgttttgatgggagacagagagggagggagaaagagaggaaaaaagcaagcaattctcctactgttacaggcctaggtagctgagtcacaggtatgtggggcccaggttgcatggcttcccctacatgatagtgtgtggctaccaattttgtacttgatgtaacagcagggttacttgcatacacttccataaccacatatataattaattaatatcgttcctcatattattatgccacttttactgtgtagagtactttcatcctacaatgtaagctttttttaagttggatatactccctccgtcctaaaaaaaggcaaaccctgagttttcgtgtccaactttaactgtccgtcttatatgaaatttttttataattcttattttcattgttgttagatgataaaacatgattagtattttgtgcgtgacttatctttttaatttttttcataattttttcgaataagacggacggtcaaacgttggatatggaaacaagggtttatctttttttttgacggagggagtaggtactaagagacctcatcgcttgacctagaacttataagttattgttaaaatttgatttttgaagttgattttgatgttttttagtgtaattttttttagtattagtttctaaatcactaagtacgcttgtaaaaattctatacacaaattactttttatcactaataaaccgttacgtcttataaataatcagacgtaggcaaccaatagacctaagaaagttggtgatattgattagatgaaggtcatgatcggttcagaaaaaaatagatgaaaaaattaaatagaaaatggttgcgattggttgaggtggatgcgtaagcgaagaaatagttttattttagaataaactattgtactagaactacaagaaatagttttattttgatgcgaagttagtagtaaattactactattaattaagtgaatctgtttggtgatggttccagggcatgatgagtaaagtactggagtatacagtacatgtatgatgtgagagagtgtgatctgttgtctttctccgaggaattgtttgtcactttgaccatgcaaaaaaggagagatggatgcatgtgatgcacacaacacatttcccagctccaggccaaactcttcaattgagttgctggtgagaaagaaaaaaaaagaaaagaagaagaaaggagagctgtccctgtggaattgtgctgttttgttctgatgccattgtgcttgcttcaactttgcaatgtgccactgtttgtttctgctgcacagtgtgtgtgtccaatgtccatcactctagagacagatagatagagagagagatgggcagggcaatgctactctcactcatatcacctggatgtcagccataggttgaggaggcagggtgcagctttattaaccctttccatcccttcttttgcaggaaacgaaaagattatctcagctttgaagggtaatctcaataacaatgaaattaatgatccatgtcacgatcaacgagtctaaagttgcatgattagctaagagcaagtttaatagtatagccaactattaactccaaatcatctatagtcaatgtaatagtcaattaatacaatagttgcttactatattattaatatctggtctcacctgttatacacacgttacgtcttgaaatctgtgctgcagctggctacagatctgtagcccgctgcttttctctctctgtttatagtctactattgtacctgctctaagctcatcagtcactacagctgattttgattcgatctctttcagtgtctggattctggcaatccaacatctgaaattaataagagagcaactggttgtcatattttactctcttggaacatctccaggagacgagcttgttggagttaaatcttaaaatcatgaacttaggctatgtatgatcacctaatttctcttatgctgaatttggtggtgtactgaccgaatgaagaagccatatggtcgccttagatgcgtcggtgtagtggttgtaaggcgccacgacggcgatgggagtttgcctttggctaaccgtaagtcgatcgttaccaacgaacgggtagagatcccttaatatctgtgtgcattgaggggatgggggtgagtccgttacgtagatagcgcgtccgatcatcgcgcgagagagagcatcatgcgctcgagaccgagggaatcggtcctcaacattaggcgcgtgtgggcgtggggtgggccaagcccattggcgcaattctctgactcggtggctagagctatcaggttagctatattttaaaacggacgaggttatctatcttaatctactatctaaattttccctagctagccatctttgctaaagaaaaagggggacaaggggttgagtggctgacgagtcccactaatccagagcagtttgttggaatgcataggaagtaaagagcaatcttttggagaaccaaatggtgatatgggtaatgaattttgccaagtcttctttcttttttttttttgccaagtcgcttggagatgctctttttcaccaaggtccctagagccaaaaaccctagggagcatccaaaatactctagggaaaacgcttccctagggtaaaccctagggaacccgctctagggatcacttctacgggaaagcctcggttccctagagtttttatgtgaaaacctagggaaaaattcagttccctagagtttcaaaccacagggacaaatgtataggtggcaacttcatctgacgtggaaagtagcttttctttgttctcatccatatttggggaaaatactggcatttatcgaaatttaccttttttttatttttttgctttttcactacctgcttttgcctcaatttgaaagaaaagaacaatcaattgtagaaaataataccattctattattaacaggaaacactcaattcatacaaactgattctccattttacatagtacttttttgtagtacaacaatagatctgaaaatttggctaactattcctcttataaacacatgacaaacttcaggatgtgctgatgtatcgtcgacaacatcacagaaccaaacaatgataaaaaaaaagaatactagttcttgtggacgaatgtaaccactgcactctagcttgctgctgcaactagtacagtagaagcttgagaacggctagatctgagctgaattattaatcttgttgttctccaacgtttccaatccatgcctcttccaaactagtcccaaatatcatcctcaatagctcaaaatctagataatctgcaaagggacacatacgaaaagtataagctaaattttaacagcactcacttggatctgtacttccatgcgttggcatgcatcacggtggaggtggaggagcagcaatcgtgtggtgcccgccggttgccggagctcgctctttggctgtaggctaccaagaaaagacagtagaagaaatcaggacacaagaaacttggatctgaacagtgcatgaatggagaagatggaagtgcggtgggagcaacgactccgaactgccgtgtcaggagcagcagctgtcaggtgcttgcttgctgcagccagtcgctggagctcgagcttggactgcaggcgatgaaatggcagccgctggacgccggtgccgaccggctaactccttggatgaagaagaagatagaacaagatgtggtctgccttgagtcatgggagtagataaggtgggaaggaaaaaaataaattggcagaaaatttgtattgtcagggtgcgctttgcttggcgcgagtaaaaaaaatctctgaaaaaactttgggaataatctattcccttttgtgctgacatggcacaactgtgtgtccttttcacgagaggttccctaggagtgcagtcaaactctagggattcagttcgttcccttgggtttgcaaaattcactctagggatattttgctccctaggattgttttaaaagctctagggaagattttaaaactctagggaacccattgaattctagtagtgatatgaagtagtattctgcttgacgttcatggcagctaatgcaaaatatactacagtctgatatacgctataatattagtgttgtatctgaataatggaggctctaatgtcttgacctcctcaggacatgaagaagacagtttttaatttcaaaactaaatcttagttttgatcaactttttttttatcaatacttaaccttggtttttatatcatgaaggtagaaatgtaaaagtgttacattaaaatattttggttacactagcccagcttatatgctagaccagccaaatagcaaatcttctggctgttttggtttaatgcgagaatttgccctcccaaatatttgacaacttaaacagtagttgctacatattgtggatgattggatgatacaactcaacttcactgaaatattgatcaagtgaaatcgcctatctatgaaaactatacaattgcgatgatctaactcaacttcactaaaatattgatcaactactgaaatcgcctaaggtttaacactaccaataatttaaacagggtggcttgccaaattgttgaccgttgagtcaccgaaagagaaaaaaattggagttaaacaatttgactcaggcaggtagttttccaagtaccgattcaattcgattaaccggcaattaaatcgaacccttgattaattgagtttgtcaactccgaggcgatcgatcgtatcgtatcgtatcgaatcgaacccaacacaaacatttgggagtgtggtccctgtcggtgccacatgagccgagacaaagagcaaacaacaaaaatccatttaggtcaattcgatagcatttcattcaaaattcctgtcatttcacatgcctcgacattcatttccaaaccaaatcttgtagtatatatattcaccgttcgataccaagtccagccacaatttcaattggctggaccaagctatataaggtttgctcaaccaagttcatcagcaactgagtcacatgaagatttgatgcaaggcataattttctataataatatttcccattcatgtgtaggaagaaaaattcttttggattgggcaaatttgacgaaattgttagaaaaaaaaagatgaatttgagctaaattattctgcgaaaaatcctaaatgctcctttggaagttgggacaaaggtttttcaagaattttttttagatacctttggaatattttcctatatgtctctttgaaagaaagggacggggcctttgaaattcctatagaatggttagatccataggaattttgaagaaaatctagcgtaacctctctaagcttttgaaaaattttctttgtgcatgtcacactctctcgaactgttgtattgtctgtctatgaagcatccaacaacacaattgaataattcatgcatttttcatattttttttaatattgcgctcacatatcaccctatattccgtgttattctattcctacattttcaaatcctatatcctccgttcctaaagaatcaaatccttgctatgaatatgagcatgtgcatgttcaaatttatagcaagaatttgaaacttcttataatttttttaagaacagaaggagtacatttcaaagtagtattttcattattgttagatgataaaacatgattaatactttatgcgtgacttgtctttttaatttttttttcataattttttcaaataagatgaacggccaaatattggatacggaaatccagtgtttttttttggacggataggttagttcttagtgaaacattgttgtttttattcctgtactggtacaaatggacggagaaaattaaaaccaacgtcttgcaatcccttcaggggagtacatggcaaagttgtacaacctgtctatggatgcagatgcagatgcagatgcagatgcagaagcagatgggtaagctatcttctcagcgtccgtaccgtgtaatttaatgcgtccgtacaccaatggatcgtgggctttgaacctgcaggcttatcctccatgtcccatgtctccatgcagcatcacgggctatataatccttcttcctctgaccacaacctccctcaactaatttcgtctacaatctagcactctatcaatgttaatgatcttgcaaacaatatggaaaatggaaattacgaagcgagcgcaactcagttggtttgattcctcgtggtgaaacctgattatccgaattcaattacaagattttaatatggctggttgtatttatgcgcgcgtagttttaagcctacttagtatcaatatatttttcttacaaacaatatcaaaattaatctttctattttctaaagcaatttgccaggggttgctgatctactgtaatcgtcaatgtggtgaattgatgttgttattttgccaagttctcttaattaggggagtattttgtgactctagctagaaaaagttaaggcattctttaatttttgcatcatggcttgtttcttctagaggtttaagtggaactattgggtcacactgacagttttgtatagtagtaattaatagcaatatcactaattcactatactgttttaaggatgtcaagtctcatcacaacaccgcaagctatattttcttaaataaatgaaagcacaggctatatgtatccccacgcacatcgactatactacctccggccataagttttaaaaatgtttaaactttgaccacaattatctttttaataaattttattcaacttttgaaaatggtagggttagatttacatttagatttatctttaaaatattttcgaaattgtaatttacacatatgtatttttttataaattttataccgctagtagtaaacaattaaacaaaatggtggccgagctttttacatatgtttttacgtgtgccggagtcggtcgacattatacctacactcctctactcatatctcttgtgacgatacaagatactcatttccacaaatctcttatctttcatttccacatatgtagaaactactataaccccttatattacataatataatctaccgtgttacataaaaaacaagtttcttcatggtcgtggagatatgcaaaattacgcttagagcatgttttctgccaggtgcagtttatcccagaatcagaaattctcccgaacagtttaacttttcattcaaattctaatacactgtagtcgtagaatagaaaaaatgaactagaaaatagattctagaaaaacccagcttctccattttatcataaactggctactaactagctacttatcagaattttaagctcccaaaacaagcgtttatttacaaccagaagaaaatgtattaaactaaaggtattttaaattaggaacttagcttctcaaacaaccaatgtaaaattcattcttatggagatttgaactcatcaagaatcttggaatgctacttacctcctgtttggaggagcttaagattctgagaagcagctgctgaggaactagctagcttctagttcatttctcagattctataactacagattattagaatttgggtaaaaagctggattgtttgggggagcttctggcaactggagattctaggagaagctgcaactgttagaaactcctccaaacaggcccttagatcactgtaagagactgatacgtggtcgatagatcgtgacagtgacgtactctctccgtttcacaatgtaagtcattctagcattttccacattcatatcgatgctaatgaatctagacatataaacggaggaagtagctacttattctttgtgccagctagcatgcatgtgtaaaccaaccgtacgtgcacggtgaggaccagaaatcatgcaacagctaacgtacatatatatggtccagtgcgaccggccgaccgaccgaccgacccagtcacccagccacccctgccaaaatccaccccgatttcgattcgccaccggctctggtcgtgtcagctacaccgtggggaaaaaaatcaaacaaacaaaaaatatttgatacataatttccattttctaacttttgggactatcgtacgtctttaaaaaaaattgtgcaagttttctttatggaaaactttatagtacaagcgtacaaggaaattgctattacaatataacatgcacgtaatattaaaaacacacgccggcagagtgatattatagtaactttccgaaacccgatattatttctacgattttctatttaaatggcaccatttcaggtaaaaaaatccattttaattggctagaggacaccttactttatttagatgggtgaatggggcaaaatgttcacatgaatatattaaaccgatatcacatagaacaaagctttggccgcgtaagcacggaagcctatagataagagagaatacacaaagaattacaaggaagagaaacacaactacgatgtaaggtgaattggaagcgagtctgcagaccgataaaatatggtggcttgggagtatcaaacctccgcataataggaaaggcgctccgactacgatggctttggtatgaatggaactttcactgacaagccatggatcggtatgccaacgccctgtgacgaccaagacaaggaactctttgctgcctcaacaacagtgttcattggagatgaaagaaagcattcttctgggaatctccatgggcatcctacagcacgctaaaggctatggcacctaacctctactgccactctaagagaaagaaaagaacggttgtcaaggccttagatggcaataagtggatcgatgacatcaggcacaaccttaccacatcactactgactaaattcttccaagtcttcgagctgatctagtccttggacactaccctaacccaaggagtggaggacaatattcgctggaaatggacaccgccgggaacctacactgctaaatcagcttaccagatgcaattcctgggtagcacatagtcagcttcagcaaacgcggtctggaaatgctgggcgccgtccaagtgcgaattcttcacctggctcctcctccaaaacagaatctggacggccgatagacttcaacagagggagtggccaaacaactatttctgtcaactctgcttcagaaacctcgagacggtccacccctcttctacgaatgtccaagcacgaggacaatctgggacactgtagtgacaaggctgaggattcctcagttacgaccgccgaattagcccaacacatcttcccttaaggattggtggatccagaccatccatgccatggctaaggaaaaaataaatatggtcaaatcgatccttattatactttcctgggaaatatggaaagaaaggaatagcagggttttccacaacatcgaagcttcattacaagtaaccattaatcgggcgattgatgaagtatggctatggcgtgcatgtggaccacgggcattcaatccctgcttccggacacccgtggaagtacaatcggcaatttgtagatcgtgacatgtactcctaatcccttccctctagcagtcccaccctacctctctcgtttttcttttgtaatctctagcctttgggctattgtatagtgtttctccctactttaatacaaatacaccccgtggggtttaaaaaaaaagagagaaacacaactacctaaaaggacacttgagatacactaaaagaacagggagagatggttaacagaggggtatcaaaaaaattttcaccaatagaatcacaaaaccaaaaactcctacaacacagacactcacaacgcacgcacacccctatgagcatcttcgaagactaagccggcaaatccatcttgaagattgacgaagtcatcacagacgcctcgctgtcgacgagtgaaagtacatggggagtcaaacccaggacctaagatactagctactaggctacagaccctttcgcgccacatatcatacttacttgacatatgtctcgtaagcattcatcatgctactaagactccagcttagatgatcgatcgatcgaaattaaagctggtggtgtgtacgtgtttgtgtgctggatttttcacattttggtccttttgaaaaacttatttcgcaaatagactcctagaaaaacttatcccaaaaatggtctaagctggctagagggagtgcgccagagtggctggcgccccccccccccccgaaattttttatttttgttttatttgtttgatatttttttcacgcttagggacacacaagaaccaaccatagaaaaattgaactcaaatggacgtaatatgtgacctgtagaatttttcctctcctctcttctcctctctctccgaactagtgcagaggagagagatgtgcaacttttttttattttatttttttgatatttttttcacacttaggaactcacaggaactaaccatgtaaaaaataaactcaaacggacgaaatatgtggtatgtggaattttccaaagctccaccgaaaaacttatctcctcgaaaacacaatcttgcaagcggaatttggaggttttagtatcgctgaacccggtgaagcgggggagaatcggatgtaactttttctgtagatgtccgtgcatatattatttgcctgattccgagtccgtaagataaagttacgcctgttttaatagatgacatattttgtccgtttcgatagagttttggaaaattctacatgtcacatattttttccgtttgagtttattttttatacggttagtttctatgttctcctaagtgtgaaaaaaatatcaaaaaaatgaaataaaaataaaaaaattgcatctctatgtactgtttaacttatatatgtcatttcatgtggttatattttgaattagattaagtaatttcatatagtggtagagtgcattatgtttaacatgctgatcaaagggttttactaaaagagttatggtctaattttagtgaaggtgcaaagtagactaagtggtatgctagctattttcagatttagctaagtgatagttcgagtttaaattttttttggtggttggttgtatcgtgatcctgagtgtgaaaaaacatccgacaaaataaaataaaaatgacaccgttgcaactccatacagaaaaacaggaatggaggcggcggcgccagccatgctggcgccctcctccctggggcggcgccagcatggctggcgccctcctcctgccacgtcggttaacgtgcgccacggtggcaggaggacggcgccaaagaggctggcgccgtcccgttggatgacggcgccagccactctggcgccccaaaaaagaccatttctaggataagtttttttagaggtctatttgtgaaataagtttttcaaaaggaccaaaatatgaaaagtccagtgtttgtgtgggggccgacataccggcgacacgactgatccaggcattgtgtgcacacatgcatgcccctgcatctgcatggagacctttctcctatatgcatgtgttgcatgcaatatatataatgcatgcgtgagagacaagagctgtggccatgtctctttgccactatatatattctctctacatgataggcggagcaagaaaattggttcacgggtattataatacactaatattattcaattcttagtgttatcttaaatgtccctatctttattgcctaaataatacaacatggatttcaccgaaagttgtcagggtcagctaaccaaggcgattgtattgtaggctacaatacaatgtgtacccttttctgcatatatactatccccgattgtactgtagctccatccctgtcatatatatatatgctatccctattttttttattgatgttgcttagtcaaaattgaactaaacattatcaaatatttggggaatgaagtacatcgacacacttatgcttgcatatgtgtaccctgttagtatttcaaaatcgacaaagtatatttccttgatttttttcaacctgaaatctagggcatatttttttccctttctaaacctacatattaataaaaaaatgtttaaaatataactacatgaaaatatttttgtaaacaaatatatgtggggtgtcagttttacatgtcaaatatagtacttatgcaaatgtatatacccatttaagatttcaaggtttgatcaaggataccttcaaataaaatctatttgtaaattgagggagtacatgcaggataaataataagtcaataacgagaatatcaactaatagagaaagggcctgtaacctagtggttacaagagcctcagtagcacctgaggtcctgggttcgctcccagatttatcggcattgtgctttcagtggtaggcaatgtacccgtcgacagcgaggcgcctgtggtgacttcgtcctcttaatgatgtttatttgatgattctcacacatctaaccctgcaagacctaaagaacaccaattggtcaatttaatttcttttgtgtgcaaggcatatctagatgcatgcatggcacatttgtgtagagaaacacataaaagtattgatcttcacacagttgtacgaatttaaagagagcctgagccaatttctccatgcatgttgagtctcatcaagggtgcctatcctggctagctactattggctgctactgcacagtaatagtatgagcatccatccatccatccatcccctccaaagtccaaacaatggagatcgttgtggcccatccccgatctatgaattggtcgaatcatgcattcattcatgtaacgggtgcccacacctcccctgtgcccaaacatggcctcatgttttcttcctttcaacatagtgcatgtggccctcctagctagggctttgtttccttttcgtgccggctactgtgttgtgcggacaagtcgaacagtgctgttgtgttcaggaaaccgttagatccaccgttgtactttgacataacgcacacgtgcgggaatccagatctgtgtcaggacacggtcgctagattatagggggtgctacattgacattgtcacgccgacaagtagaatgtatgaatgtgctacagacgtcattgtctttactgcaaaaagaccgtacctagaaacatggcataatgtattgaatcaatgacgttggataaccgtcggatatgcaaaatagggacaaaacatatgatgggcccgcctctacccaccatcactttatttattggatgaatattgaataggcatgcatgatgatactacctccgacaactcaatatacaacgtagtctaggacactaggtagcaataaaaaatttaaaactttggtccctatatttatatttaataataactagctatatataaaacgcaatggtcaaaacacatgattgaatcaagaccgaaccaacaaacaaacatcctttctaagaatataaacacaacgacatgtcttcccattgataaaaaggatcaaaggaacttcaatttagcgcgggctgttgaaattctattggttttcattagaacttcaatctcagttttcattatataattattcaccaaagagctaattttggaactctgtgtttcatggaaatcttcctcttagctgcttggaatatttggaagcacaggaataatttggttttcaattctatcgtgccctcgacctcaagctggaaatctgctcttaaagaggacctaagtctacatttacttagacttagagatgaccaaattctttttgctcaatcatggatgtctctattgtaatttctttgtaactttgtactcttatctcttttataatatataccgtaggggcttcctctactgttcacttttcaaaaaaaaagggatcaaaggagagttaagaatatacacatgaagccatgttttcttattaatataaagaatacttgtacatttagactagttacatagggtggtattacaacgaaaaaaaagacattttttatcgtagatgaaattacttttcagagctataaaactactcatatacaattagataccgagttcagtatatttgaagagcaaccccgtcgatatttattttctggatcaacccctgagttcattctaacctatatattatcctaatggatgtacaaagctgaagttgggtctggaatttgggtaggtgtagttacggtgatgcaaagagagtgtgttctttgccaatcttggagaagcagcagtaactagagcaataaccaacggcagcaataatatgtaagtggtagtacagtagctagtaccgatttattttgcagctagccgtccaggggggccaatgattgacatggtttgtaatgccgtgcaacgcctctctgaaaaacctgcagaatctaacctgtttggcacgatgaattcatccgggccggtcggtcggtcgatcggtctccaatctgatgcatggtcttgtccatcgtctgctagtattatttgatcatctcttccaatagatctttctctcatctctcaataaatggcagctttaccacttgcaagttgttgttgcaacacctaccaatcacaggcttacagcttactccctccgtcctaaaaaaaaaagacaaactctgggtttccgtgtccaacgtttaactatccgtcttatatgaaatttttttataattagtattttgactgtctgtatccaacgttagatgataaaacatgattaatactttatatgtgatttgtctttttaattttttttcatattttttttaaataaaacggacggtcaaacgttggacaccaaaacccaaagattgtcttttttttttttttttggaacggatggagtatctctctctctttcacaaacagtttccatatgacagaaaacagtgattttcaccgctgctggctactgaacatttccgctgcttctaaactgcacacataccattatcttataaaattgcacgtatgtacctcgaatttttgttttgtactttgcagataatttgttaacacaataactatgtgtacgttagtagtagtatgctacccctgtcctaaaatacggattttggcaagacaaatatatggctaaacttctttatattttaggacggaggtaataagatagtattccctccgtcccacgaagactccatttttcagtttttggatacaacgtttaacgctttgtcttatttaaaaaaatttataattagtattttttttggttagatgataaaaacatgaatagtactttatgcgtgactatttttttctcgtaaatctttcaaataaaatggacggtcgaatgttggacgcagaaacccaaaaatgaagtctttgtgggacggaggagtattaaatgtgtggatgacatgtagggcctaagcccgatgccccgaataacaatcacgcagcaatgtaatttatcaatttttatgaattaccatatatctaattcatgtaggaaatttcaaaaactttaacatgagaaagcataatggtagcatatcgtaggggaggttttcgaagagttggatatttcattaacactaaatgcctaaaaatatgtcactgtataaagcgattaaaatagaaaaagagaatcaagaaacctctacaacttcaagagctggttgggggttcaattttctcacagtgatctgatgcccccctataattgcagaagtgggaccagtccaaagaagcaggtctttgtaagcaggctttttccatggcatgcattgccaagtgaggagaggagaggaccaccacaatccacaagtgaggaagactaggtttaagaggaggatgactggatgagaagagatcaatggaagaagatctagatagatagctagctagaatgcttgatagataagatgatagaaataattggccctggaagcatggaccatcccaaactggtggtggtttttggagcagtgcacaaccatgtctcccatgtcccatgcacttggagttaattggtcaccaccaacaatgcctgcccatatattgattgcttttcatccagcaaaaatatccactacgcaaattggaagtccttgttttgaatgcgagaaattttacatgaggttaatttcttaactgtactatttttgtaactatactattttcaacaaaattcttggttcacggctcttggaatagtgtcgtaggaaagggttggattgccgcaagatgtacgcgtagaatcttggagtctcacatagcctagggtttgaaattttgtaggagatagacataggggaggggacagaaaaaaagatagtagatatgaagtgatgtgttttgtgtcatgttgttagtgatggtgcagtaaaaggcccaatgatggagggaagaaagctggggaacaaaaggggtggggttctaaatggcagtgggctttgagatgggcccccatccttgaggctgcaggagaaagggaggcagcccccatttccccatctgtaccttctctcagagcccccttcaaaaattcagatttcagaaaccccaccactcccaccattattgtacaatcactttgaccattggtctccttcctcgtcctcttcctcttcctcatcctctctccgcaatcatggagtgtctacgtgtgatactactatcgctctacgtacacatctgctaattaactatctatgacaattggacccctgacaattattgttctaacaccggctataatatctaaattttagtcatgcgttcaccattgtctttctggaggaaatatgtagtgtaaaccatatataatggaaaactagaaactaccgttaaatcaaaaaatggacattccagattcgtccacccagtaaaatttttacttatgagtaaatctgcgagtaaaatttttactcatgatgatgtgaacaaatctcaaacatctatttttcgatccaacggtagttcgaaatccatatacagaaaacgtggttagtgacgtgctgtaccaccataaaaagctcacatgcgtgcttcttggcacgtgcaagcagcagaggattatgtggtttcaagtgcctccagtgcattgcaatttgtcagcgtgtgggcctgtggaatctctgcagcagtgtacaacaatctttgcattgctgatgaattaattatctggtccaactaacataagttgggtccagcccaacgaatccaacatttcagcctggcccaccaagactaggaaggaggatttattgtaaagtacagaaagagggtcatgatcatcagctgcccaattcccagagtatcttcttttactcagaaattcacaaagaactataacatgtacaaccaaaatcaaagcatgctcaatcaactacggggagcaggcgtatgcgaagacaatttttacatcttcattcttcgtcggaagtgaagatttcatgatgatccatcaacagtcagatggccgctagcttcatgatgcaggatatgggcaagcgccaaggaatggttccagtgctgccagatgatgtctcaggaagctgtacacagattctgtgctcactgcggttatccgagcaaccatcccagtgcccttcagcaagaggaagaaaaaaagatgttatcacatgtttctagaaaattgtcgtggtagtgtcaggaaagctggggaagtaacaaaccatgcgaccgaatggactacaggaggcgatgattggaggcctctggggatgtaggggttgtgatcttgtcgagtagcgacctccggcagaagtgggagggcgcagttgtacagacatcatcttttttacctcatcttgcatctgatcttgtatgtgctttaactttggtctgcaagggaaagtatgccactgattcactgaaccattgtctgtaagtaatccagatctagccatctgggattccactagtaacttgttagactgagtgaaccatagtccatagttcctgattcccaacaattttcttcgaaatctgaagtaaactatggtccatggattcctctgattccctacaattttctagaaattctgaaagatcctcaactagcataattgtagtaactaccaaagacaaaagaacacggttgattatgtgaaaaccgaagcagcacataggcagtagccaaagtcatatctgcaaaggtcgagaagacctgtgcagaaggcaaatttcagtgtttgatggccttaccccagcaaaataaccattgcaaccacattgtattcctgcattcggtcagcaatactaaaatttgagctctgttccaataaaacctgctcagacattagaagaggttatgtggcatggcattaagcacaaccgatgattagagtggggatgaacaagattaatcaggcaaatgttaggagaagctgaaaggtgagctcttaccgagtcaataaatagaggctgatcttccaaaagaatatggttgatgctcttgtagaagctgaaattccatttttctccactctcgtaacgaccacttgtaaaccagtctacaacgactaagtttgaattgggaaagacatgaaacacttgcttctggtggtatcgagccattgagaagcaggttacaggatctggaataagtgcaaagagtgcatcttctccaactcttgcctactgcatataatgaagaatcattataattgctattttcttaaaaaaaaagttgaagttccctagtaagaaattctgaggagtatcgaaatttcgaaggagcattacctctagcacctgctcagaacattttgaatccacggccttgtacacctaaacaagcacttggccattgacaaacataaaacaatcaatatatatggttcgttaaaaaaaatcaatatattcctcaagaactaacttttttcagttaaaatttcgataatgaagtatgttattacacttgactacgggtgcattgctataacccagctgctgtgtcaaagacgcacaaagcccaatatcatgttattacaatagactagtttaagtcctaggttgcatttggtaattctaatagcataccctacacttatatggaattgacatcaagacccctctagctctagctgtaacattatctaagggtccctttgaaacgcgggataggaaaaacgcaggaattgaagttgcatgtttctctaatcctacaggaatgaaaaacacaggaaagatgaagaggagccctttgatagcatcataggaaactaacaaagcaaaggaaagtttccaagaggttgggcctcttgcttacttcatatggaatattctctatccttggctcgatagaaataaaaaatcatttagaagattaaatccttcaaaattcttatgacaatccatcatttcaaaagggaccctaaagttggcaaagattttgcccttctttcaaaaaggaaaaaaaaatacggggggggggggggccctaaaagtgttctagctgtaagcatttatgagaaacattcgttcactaacctatgtcattttctccaactaaggaaatgtaaacagtatttactcggccaatcgcatgagaacaattgaaagaaaaaaggaccttagtggaggcctgcgtggtcatcgccgccgcgcacccgtcgccgacggccaccgtgcaggagatgatgtccccctacaagcacagcccccaaaaaagaagaacaaaaacgcatcagacactcgcactcacgattgcctctctctcgagaaaggaggcaaactgttggttggttggttgattgcaatccgggggaggaagaggaggcgatgcggcggctcacggagacgatgccgccgccgtaggtgatggcgtagagccacgcggcgccggaggacgcgcgcccggcctgccagaggatcgccgacgaggtgaggtcagtggctcatcgcagcaaacaagcgaaggcaatctatataatggatggaggaggtggtggaaccttggagggggcgatgagcttgagcgggtacttggcgaagcacctggtcaccgctgacctccccctcaccttctccacccgcaccgcccctgtcgccgccgctggcgccgccgccggcgccattgccgcctccgcctccatgctctttctttctttcttttttctttcttttttcttttttttttagaatgaagtccacgataacgagaggtcaatcacgctttcttcctctcttttttttccgatataagataatagcacggcccactacgtcacgtgtgggcttgggctgggatggggcaagtgcacctgtgtaattcaatattgggccattattctactggacccaaggcgagatcgactggtcctacccaagagtgaaatgatatgcatcggttctaaaatcgtttttggtggtatcttgatactctacattgcattttattttaagaaacgtagtacaaatttttggacttcatatgcgcggagcaactctacaagattgtatcggtatatcttcgagattaataagtcactataagcatctcgctgtcgacgaatacgtcgtgtatcactgaaaaaataattagccgtaaatgcggacattaggacttgcaaactagattttatttgaattcaaaaataaaaatgatctaaatgcatttgtttcaggtatcttcaaaatcaatgttaaataaaacaattagcactagtgagtggttttctcttgacaaatcttttttatactatattattataactctattatcataattagctatatataattaacataaatattaaattaaacttaaaaattatcataatacctcgttagatccaactttaagagccggatcactttgatgtcatcttcaatcataccatttttttttataaagttgtcaaaaaaaatatctacgtttagtttgttgctacaattttaacattatcaaaatttagtaagatttattttggctataatctgaacaagtcctaaaataaaacaataatactatactcctacctaaccaaccaacctttgcccctacctaataacgaaataaaataataaattacctaatgcagtgggctggtctggtgcatcgcccaccgatttcatcgtgccgtgactcacatgccgcgccgaccgggacacgttgtgcggtcggtgtcggtggctgccgcgctttccgaccgagcgcgaccgcaccacaatatcacgcccaggcgcgcaccgagccggccttatccatctctggccagtgaccaccccgcgcttcacttcgcttcacttcggcttcgcttccatggcgatcaccgcggccaccgccgccgccgccgccacgccccacccgtggcaggccgacgcctcgccgcgtcgccacgccgcgtgccccgctctccgcgggaggaggcgcctccccgtcgtcaggtacgtattacgttgccttctgcggccttggggggcgcgcgcgcgcgcacgccaggtgctcgaccgattgcctctctgtgcgcgggtggctgagctgtggtgtttggggtgggggggggggggtgatgttatggtggttgttgttgttgttgaaggtgccagtcgtccagcgtcgacgacaagcccaagtccaagcggggcctgctcgacaacgccagcaacctgctcaccaacctgctcagcggcgggagcctcggcgcgatgcccgtcgccgagggcgccgtcaccgacctcttcggccggccactcttcttctcgctctacgactggttcctcgaggtgatcaccccaatcaatctgtggctcttgcattagtatttgcaatatcccacgcacatttcatcgctactgcgctacttcgttgcacttgctaatttttttttccacttactgcaatcacacatacgtttcgttctcttatgatcaaaagcatgtttgtccactatttcatctccaaactacgttacatgattacacaaattttaatgctatgtacattttattattgactgtctgaattttatggttcaacgccatttttgaactccatgttcaaacttgactgtttgtttagttagcatgccttattgccttaaagttgttttgcaattctagcgatttttttaactccacatcacaaacttcacaccctttttttttaattagcacgccttcaagtttttttttttgtttgcaacttcataaatgcattgctaaatgtacatttcaccattcataaaaacagtgaagatatatgccaatagttggcttgcgtccctgctgttcaggtttatgcattatttcttttgattctcattagtgacttacattaccaatttaccattaggttcataatcaagtagatatgtggacaagttgtgcaacaatgcaggggcaaagccaggataaatggtcaccggggtcagtgttaaccagggtttatgctttcgaccaaaaccgaccaaaaatcatgtaattttgatgtttcgacgtgggacgaaaagtatattctgagtgaaattttgaatgtttttggagaattcacggcaaaactatatcaaaacttattaaaatttggtgaaaaatgtcatatcgctacattgtaatccaacattaaatcggaaatgtcatctagtttgtaattaatgatctaagactatacataatacaagacaaaattaatgacaatatgataaaatgaaatgtctacaaatttgttaaaaactatacattattaatttgtaaaacacaccaaatgcaccaaagattatcaaaaccactaatttattgccttccgttctgctagaaataagatgatataagatgtcaagatgtgcaacgccggtgcgggacaaagtgctcgaaggaatacgatgacgcaacaagagtatttgtggagttatttttggacccaaatcacaatcgtatatgtatattgggctgacgtataaatcataagtgctagctaattttctatttgttgtttgttagtatcgttcctagtcactagtttggttttgacggaacaatcagcaatatcactggggtctagtttttctcttcgctggggtcatagatggtaaaataaagagggtttgagaggtttgcaaaacgtcgtcggggtcaactgaccgctatgaatggctgtagcttcgcccctgcaacaatgctaacctatcatgatttgtttgcagcatggctctgtgtacaaactcgcttttggacccaaggcatttgttgttgtctccgatccaattgttgctagacatatcctgcgagaaaatgctttctgttatgataaggtattcttctaatgcacattttatgaatatcctttgttggctcaactgtaggtggtattggatcataattttttttttaccatgatggctgtcaggtgtcagctgatttatagcatgtgctctgttgtagcaactgaattttacctgtattaatatatatcatggataactaatgttgctactagactactgtttagtttgttaggtttctttcttacatatttatgtacttgaaatcagggagttcttgctgaaattttaaaaccaataatggggaagggtcttatacctgctgaccttgatacctggaagcaaaggagaaaaggttagaaaggttggatattgaatcttagtttgtgcacttttgggtttgttctgagtgaaatgttgcatgtttctgtgtgctcatctaaggccatactgtttgactttttaaaggtataaaaattgcagttgccaatagtaatgggcctatttatcagacaattgactgatataattaaactatttcctgcctttttatgaaccaaactgtttcatagcctattgcggactttatgtttgtatttcactcaatggcatgctcatggtgcaccttttccaatttctttgttgtgcagttataacccccgggttccatgccttattcatagatgctatggtgggagtatttactaagtgttcagagagaacaatatttaagcttgaagagcttattgaaaggggcgaacatggggaaaagtataccatagtggaccttgaagctgagttttctaatttggctctcgacataattggcttgggcgtgttcaattttgattttgattcggttaccaaagaatctcctgtgatcaaggtgagcatcatataatacctatagttctaaacctctaatatatgatggttatttcttcacaagaattgcatgcgtggtaatagtctggaacatttgagtatgttatggagcaatgtttatgtcggacgtctattgttagtagacatgaatacatgatcacatggcatgcctttctgctattttctcttcccttatttatgggattttaatttctttttcctgcaggcagtatacggaactctttttgaagctgagcacagatccactttttacattccctattggaatcttcctttaactagatggatagttccaaggcaacgcaagttccacagtgacctcaaggttattaatgattgccttgatagtctcataaaaaatgcaaaagagacaagacaggtttgtttgaactgctgttctattcatacatagtgcatgttttagatctagtactggttttgatgtttcacaaacatgaaatgtaggaagctgatgtcgaaaagctccagcaaagagattactcatcattgaaggttggctgtggtgataccttactgtgtttgttcattggcgagcaccacatttcgttgttatgacttatgaccaataggttcgttttccatcatgcttgtaggatgccagcttgctgaggttccttgttgatatgcggggagctgatgttgacgatcgccaggtagtcatcaatattgttgtgaacttggtatactatgacgcctatttcttcccacacgtggcaaataagttgacaacaatacatgttttgtgctagcttcgagatgaccttatgacaatgcttattgctgggcatgaaacaactgctgctgttttgacatggtctgtttttctactagcccaggtatataagtcctttttgtaccatgcatagttcactagttatggtttactagttgggttgggtatcactgtatgtatgtaccaatcatattctaatatggtgcagaatccctccaagatgagaaaagcacaggcagaggttgattctgtactcagcaatgagacaattaatgtggaccagctcaagaaattggagtatgttacctttcatagtgccattcctgtgaattgaactgtattttagttgttctatacaaatattttttgagaaataaattggctttgcgctttcacttgaatgtgcttaggtacataagactgataattgttgaagctcttcgcttgtatccccagccaccattgttaatcaggcgtgctctgcggccagataaattgccaggtaatcttgtccctgaagtcttcagatttctcctaaatcaaaagggttatgttaaagtcacaagttagttaggtagacacatgccggatattgaagggcatgtggtgtgatgattaaagttctatttattggaaagggatacatattaacatatgcttctaatcttctttttctcaaagaaagtatgaatggaaggatgatattgcatactcataaaacgaacgtatttgttaatcttcattttatcgtgattagcgaaattgtcgctgatcaacatgtggtatcttaatatggtgggttcgttttgttatggcaaagctgccatttggcaatgttctcatactgagccacaatttgcagtgtcttgagcaagtcctaaatgtttgtagtgtgtcgtgtactcatgtccccagtttgcctatgaaaatttcatgcacattattcataggctggatgtttttcctatatttacttgtgtggaatttatagtttatttacaattagcatggtgctattactacattggttcagccacattgctttacaatgcaggatttttctgtgttctttagttcctatcatttgtagtgatgaattatgtttagtaatcgttacatttcgttaatgaaatgggagagatctctctctgtttcaaaaaaaaaaaaacgggagtaacaggaagagtatcttgctttccaactttgttaaatccatgaacatgcttccctggatccttcaatcccgtagtgtcctaaataaactatgaacattgtaatttcctactgattatctcatgcccctttgtccaggtgggtacaatggtgcaaaagaaggatatgaaataccagctggaaccgatatatttctttcggtaagatggacagttgttagatttaggatagtaattaaagctatacttgtctcctatttgagtctgttccacgacttacggaaattgttggttctgtagatatacaacctccatagatctccatacttttgggatcggccagatgagtttgaaccagagagattttcagtaccaaaaaaggatgagagcatagaagggtgggctggttttgatcctgaccggagtcctggtgctatgtatcctaacgaggttggctagtctcctttttttctctactaccttttagatgtccttttactaacaaattgacaacataacaaacctgctgttaccagattttagcagactttgctttccttccttttggcggaggaccccgcaaatgcgtgggagaccagtttgcactcctcgagtcgacagtagccctggccctgctattgcaaaagtttgatgtggagctgcgaggatcacccgatgaagtggagatggtgacaggcgcaacaattcacacgaagagcgggttatggtgcagagtgaggagaaggacctgatcatccaccagttggcaccaaaaggtatcgcttgacttctcatagcatatgccttaatcaagtacttaaagcagttctatgaacagaaacaatactatgttcgtgacaacatctcccgtagcagtagggacagcatttcatgcatcagtgctatctctgttcgacacatgggctcaaattctgcacctaaaacaatagtacacacacttaatgccaaactgactagatgatgatgatgttggtagatctaatctaagccgatcattgcacccagcaactcatgcttcatgtctcacctgaggtgtccggtttcttctaaactcagataacctgatctaggctgtggcagcatgccattcggtagtagtaagttcagagaatggaagcaagttaggtttcagtctcgtgctttcttgtcaggtagccacagcattatgacgtggatcaaattaatgttaggctgtgcaaaacatggacctctggtttatcatattgaggtgttcgttttgtgcagctgtgcttgtgccgtgccgcagcgggatgcatgcagtgcaggaaacaagaagcacacaggaataaatgcatcgatgcagacaacaaccaatacaagggtaagtaaagccagctactcctactccttagttcttttttcgctcatgatgtgatggtgtatagaagtatatactattcgattatttgtacgatgcatacgcatctgtgcgtgcctctttgacggcgaaaaatcgttggggttgaactggaaattgtgctgagttgttacttcatctcaggctgaaacagcacgtttttgcgacctttttgtggtcagcaaattcgctgtcggccaagctgtatgaatagtatggatgatccagtccattttaatcaaatctgcacagacaatgaaagctagttacttttacatgttttaagcaaaaaacactgcttatatttagtgtggtgactattttatctgccttcagatacataatagttttactgttacttcatactgtgtccgagtcacagcatggaaagtagcaactagtagtatactggtttgacatcatttaccgtgttaatcatacatcatacatcagtgggatgcttggagcctaagcaccctcgatagtaacccgaagtggaccgtagttaagcaaagcaactttcttttttgttcctttgaccacgtctaatgactccccatgcaacaagttgacacctaattaagggtccttgtaccttagagaacgaaggttctagaaggtgcatagaccgatctcaacactatatgtatgatggtattgtggaaaatacttgtgccggacaactatgacttgaatattcaacggcacactttggacttgtagtagggtatatatgtgaatatatttcgggaggagcatgcacgttttttgtcacttgtcagtaagagagcttttaggcttgtttggagcgaagagaatttatatattcttgtttgaattgcagtctaacgggattttaagatttgtttggataacccagattagaccatctaggcttttttggaatacgggaaaaatccccgttcctacatggattgaattatttccagtgaaatttgtaggttccatttaggcctaaacctctacggataaatatttaggacccttttgatttgtatgaaaaactgaggaaatttgtaggatttgattcacaggaaaaaattttatttggtcatttggaacaaaatattaagaatacaacaatcacgtaattcctacagaatggctcaagataaagagattttattgggaaagttaacttaaggttcaaccttagagagactttcattcgagtctcatctctcctctagtgtttttttatggtctatccaggtcgtctctgtatatatatgtattttgtaatcatttgttttatatttgcatccctatatctaggtcctatgatttttttttcttattctagcattttctcaatcctgtatttcaaaggtgcacttagttttgttccatagaccaaaaagaaattaggacaaaaagagttctcatctctttttttctaacaaaaaacaagcggatggactgatatagcaaggcatataaggcctgtttagttcgcgaaaaaaaaattttgggtgtcacattagatatttgaccggatgtcggaatggtttttcggacacgaatgaaaaaaataattttataactcgcttggaaaccgcgagacgaatcttttgagcctaattagcccgtcattagcacatgtgggttactatagcacttatggctaatcatggactaattagactcaaaaaattcgtgtcgcgatttcctccctaactgtgcaattagttttttcatttatctatatttaatgcttcatgcatgtgtccaaagattcgatgtgatgtttttgggaaaaaaatttgggaaactaaactgggcctaagtggtttcaattgatgaagtgactaggagctttcaaagaaagaattgacgtccaaggacaaagggtgcaacctaacaaaggcgaaagcaccgggaaaattcctagcaaacctttgacttggaggcgagatgtatggacttcataaaagtaaaaccatactccatttagcaaagctaatatatgtggtgcttataaattagcggtcaattatcgggttccagacaaggcatttagtgctatgtgaaatctatagaggatagttctcatgatcattagagacatgaaacttttacctcgtagatctcgtttggaacacatgaattacgttaattcggaagaaacaatctaatttccacaagaatttggaaatttttccgaagctccaaacatggccttattagaaccctgtactggtgtatcctctagtaacaacactaggactaagcgaaaagacatatttacaaacaaaaaataatttgtaaataaaacttctatatacgtgttcttagcgatctaaaaacaaaggctgaaaaaataaactacgatgaaaaaaaatcccaatatcaactccaaatttaaggttgaaaatttaaattttggcttataagcataaagcataaacaaaaaatgaggctgctattttcttgttccttggatactctttgaacatacgaattgggtagttactagtactagttaggcatcttagactaaaaatccctgcttccttcccaccaatccaatgttgaaaggtcaagattattgatggggcccagtactcaccaaatcccaaccaaaccctatcctctttccatccatttctattttgtattatcctatattcacatgtggtaaaatagtgacatgaaactgataggtaaatactctagtgccaagaccaataggtcattttcttaggctaacaaagctgttctcactacgtagagtttgcaaatacaatggccttgttcagctgcaagatgcagccgctgacacaaagtactatgcatgctggctgcgccacaaccgaacaagtgtagccgagcagggccaatatttttttcattatataataataatagagtaacgcattactatttgctgatgaaagaacatgccacatcaatattctattatagtattcttttgaaacatttttttgagtgtgtatgcttgtgcatcttctctgtaataaaaaagaaaaaagaaaatcgatatccatggaggtaaaaaaaaaaaaagtaaaccttccatgaattgcctttcatcaaattaaaattgtcccccaaagacatgtcgttgagcaagctaaactatgcaacacagtaaaattcttactgagttttgccaagctttgaagcaagttaaggttgatttcattgtaatctaaatactgtagatcacaaatgaaacagcaatcttaggcaagcaacaggtgttcaatcaaaacaagagcccctcccctctctctcactatctcataatgcttcattagaaaaaggaggtagcagagagtgtgtggtagatatgttaattatcagggagcatgtgggtatgtgacgacggagtggaagaagagaatatcaagtcaactctttgacccatgtcatcacgtaagctcacacgtcacccctcgtccgcatacgtcagctgggcccccactccagtgctcggctcagctgctcttgctggctcgagccgagccattcgcatgtagtacaaaatttatactcgaataaatttgtggatatattctaatttctcgcaaaaaaaataagaaattaaaaggtatcaacaataatttgtgatacgtatatactggagagaactgatgaaacaattcgtagccacacatcgttgtagtaagtacgtcgtacacaagatgctttatgttgtcaactcaataaaagtttgaatacaatttgtactacatgagttttaatcccaggtgcagtcacgatcatgttgaaaaccaccaaacagcacagtccagtcgcatttgaccttcaattagtcagagacgtgcaaactcaaacaaacaaattaatactaatatacatatctctcttggtgatcgggtagctaagacggaaggagacaagacaactggtaagtgctttgcttggctgccgttttgacacaccaaattaatcttcttttgaccaagacaaacaagcagcaacatttttagatcgaaatccacatgtatagtagagttcgtgcttatgtgtataaatattttcacaatcacttgtcattctcacttgcatatctttcagatggaatttttgtaagtcttttgaaaattgtgtgtgtatatcctcgcggtgtcaaggatggaggttatacttcctttgtaaaaaaaaagaaaaaaaacattaaatcttagatcaatccgcgtgtacgatatatatttgcgcatttgtatatctacacaatgagttgtcatttctcacatacgacggtatatatgttttgtaattcacacgtcttttcaatggaacttccataaatcttctgaaagtttcacaaacatatggctagtgtcaaattaggcttcaaaggggcacgtggtgaagagattcagctcacctagctcatccacgtccccatcttagctactctttcatctgggcgggaaagagggagaggacgacgctgatgacgaagacgaagaagaagaagaagagaatacggtaaaaaggaaaaaaaataaaaagggttaatataccgacgagaagacgtcgtttttggtctttttggcactgaagcttcgtggctatagcttgcaaaagttcctctgaatttgtgatcgatctcgtcgtcgagctcctttgtcgaattcacatgtaaaatgcttgctgtgtaaagggtagacagcgctctatttggtgaccgacgaccaaattaaagaaattattcgccggccgtctccgatcactggctgcttgcacatatgctgatatgcatttttcatgttcagctctctcaagatagcaagaatatacaccctccgtcccataatataagagattttagatggatgtgatacatctcagtacaatgaatctgtactataatatatcatatccatccaaaatcccttatattatgggacggagggatcggagtaatagctaacttgtgatgcggatcggggtccattcatacgcgtgtttttaacatgattgatctagctgctatttctgagttatcatcatcgttgccatcgcaagatctcgatctatcgtgcatctatcataacccacgcacaacagtgctgaacctaaaacaaaaattaccgaagatgttatacacacaatgatataattattgactaatatagcaattaacatggtataaattggatatagatgatcaatctagctgaagtcatgtgcaaggttcacaaaaccaatctttgcgcgaaaaccaaccggtttttgtgaaaccgttggtactcggtttgtggaagccgaacggtattagctgatttttgtacggtattgactaatatagcaattaacatgatataaattggatatggatgatcaatataactggaatcatgtgcacccgggaagatgcgcatttaggtattacgccactgcgcaccactagctacttccatttcttttgatttcttcagttaccaacaaattattatactgcattccgagtatatacgaaacaatagaatagagataaaaaaatccattttataaacttaaacttgaaccaaaggtccaaaaatcagccataattttattttatctttttaccaaaaccatttgtccttgaaggttgtgctagagaggtgtgaattttgtttcttatttcgaaagattagctaaaaaattgaaaaatcaaaatatggttttcagagtaaatttcttatttttttaaaaaaaaaacgtaccaatgtgctttcggaaaaagaggaaataggagggtagaaggcagcccaaatcgttcgacagtggtgtgagaatgagatccaagcaactctactcctgttcaagtgaagccaacgtacacatgtactgcatcctgcaccggtgtgcccgtacatggttatagtactactagtagttatcgcacgctggtcgccggcgccatcaacgggcgacatcacactatgcagccgagccgacagccgacgatgacgacaaccaaatcaaccaaaaccccacccaaaaaaatgttaaaaggattagcacaaatgtgaaccaaattaatctctttcggaaaagaaatgaaaaataaatactccctttattccaaaatatataaaattttgaatagatattattataaatcaaacctattcagatttatagtattataatattaatatgtctaatcaatctaaaatctcttatatcttaccatcttcatttcaaaatataacaatctctaactataaattttagacagacatttaatctagatttataattaaaaatatttatattttagaacaactagatttatagttataaatgattatgtagtaaaaagatgtgaaaagaggaaggagagaagctgcctcaagccaacggcgccatctcctctcctcagtgggtgggccccaccccctcgacctttcgaggaaaccccgcttcttcttctacttctctctcctcctttggtcagccaaccccccgcttccagaaggcgaccacgcgccaatcccgaccgtccgatctccacccccaatcccatccgacggctgagatgacccctcccccacccgtttgacccgtcgccgcccaccctataagtagccgccctcctccaccgcctcgagaactctccacactccagccatgggcgacgccggcggcggcatggcggcgcactgggcggcgctctacggcggcggagttaatggtggcgcggcggcgggggcggagggaacggtgtcgagcccgacctccgggggctcgccggtggcgggggggagcccgacgagggggggcgcggcggcgctgccggggatcgagggcgggcgcgtcgcgaagcccgcgcggcggcgctccagggcgtcgcggcgcgcgcccgtcacgctgctcaacaccgacacctccaacttccgcgccatggtgcagcagttcaccggcatccccaccccgccctacgccaccgccgccgccgccggcggcccggtcatcagcttcggcgccggcgagtacggcggcggcgccatgcccgtccgcccgtccccgacaccggcgtccgtcatgtcgttcgaccacctcggccaccaccaccgccaggcggcgtcgtcgctgcagagccagctgttccggccacagcaccagcaccaccaccagtacggcggcggcggcgacgtcgggtacggcggcggcggcggcgacatgtttctccacgggttcgagtcgtcgtcggcggaggagaggctgctgctgcagagcatccaggcggcgcagatgctgccggcggcgaggccgacgaccacctcggctaacaacgctaatggctacaacttcggatgattaattagccaacctcgcacttgattagtttgggtaattaaggtaagcatcaagtgctaattagagagagagaaattgaattaaagatgccattagttaaggctctttaattacatgatcaaccaagcatcatatggattgcttgattatttctcctcttttgtctgcaccatgatgttgttttaattttaatttttaaggttttatttttgttggcctttgctgtagagagatatacccagattagcaaggctgattaagttctttattaatacagtaattagtggtagcttagctagatgtgaaatggaatgaaaagcatgtaaatattttctcaacacagtactttggttaattttggtgtgtagcaagagcacttttggtgatcaccactagtgcaaaaacttgatatttagtgaggaatctttctccctttctagattgccttgctttggaagcaaagtttgaggatgctactatatcctctcctaatcaagtcgcgacgcgaattaatcacatgttgttttctcgaataaaaatgtgcttttctttctgcctaccaacccaacccattgggtttgatcgatattttgttctcttctatataaatatattcttttccgagttatatcttagtcgctgaatcatcacatatataacaatacattttttaagctatgtcttgatccatcatataaataagctacatcttaaccgctgagccatcatatatgtgtaatatacttcacccatcccaagatataagagattttggatggttgggatatttaatataaaactgaacttcctatctagattcgtagtattaattaggagaattcagttccgtaatactaaactgtccaatccgtctaaaatttcttatattataggacgacgaatggagtatatattttgcatatgtctcttggcagctgagcgactgggtgtgaatggttcatttctacctacacatgctctctttgttaggtggtcgatggattaatgggtctatgtgctagggaaattttaatgggtcccacaagaataatctgcaactcgattgatctcatgacgatctgatgatgatgatgccaagtcaaagtaataactgttgtgctgtgtccctctaaattaaggtttagaatagtctcacacaaccactaatagtagtttaattgagctgaacttgggttcagttaaccatatgcatggtgtgcaggatggaagttagctagcctccattttttgtttctttctacacatatatgtgtgcatgatgaatatgcctttgtgatttctttaatttcactttcagagatttggtttgttgtgcaactcatcaactttttttttatcaatccatgatgcttaaggtcaagcattcacacggggtattagattagcatattacgcatccttttgttataagagcaagtagatgcttatatatatcaaataattaattaataggcgtcgtcgtttagcaattgacatgtttgtgactgttggggtccgctgttagatattctccctctagtttcgaatacaagttcttgtagctaggtttgttcacacaaatctgcacataggtgtgtttaaaatgcaatggggattgtctgcagcccctgctactgcatcagcagtactgtagaggatatacatcctttaaaatgatggtgctattccacggttaattacaacgatttcattattttcagcttattcatcatattattgttgctgattatttacttcacgcttctaaaaaaataggattattcaaaaataaaaaaaattctaccgcattatttgaagttacatatgtaagtttatttattaaaatatttaatttacccctatactcaaagtagataattcgtggctaatcctatgaataatctatttcaaatatatactaccttaagattgtccgatttgaagatcataaaaggggaggaggggtgaacatcgccctcaagattatcaaagcctaatatttggagaagagttggaaattctaaaactgaatatactgacaagtgggccagtttgtaagcaaggtagcaaaatcatttatgtaaaattctctctcaaacttaattgaaaagtaatattttagtgattttagtgtccaccagtaaaatatcacaaaatttccatatcttttagcaaatccatatttttataatgtctaccagtaaacaccacgatttttaagtgttatatagcaaatttttaccaaatgagtaatacaaaatttgccaatatatcacagaggcatcgttcaaaaacaccatgttaatgctattttatgcccaatcgcccatacctataaattccaaagacatttcgctaaagtttttttaatcaaaactacatcaatttaatacattttagtcagatatttcagaaaactgcactgcaacaataattgattacttcatcataaaattgcaactttatacgcttgccgtgagtctaaacccaagcactagtcaggcacagatgcaaaactcacacggtcatcagaaccttatgttaaagttacagcttattgataatatcgtttgctaaagttctgtttttatggaatcccgatggttaaagttgtagtaaagcgattattttcgagtacaaattttgtgaaatttactcaagaaaaaagaaagactgaacatacgctcgttctagctagttgatgctccttaattgaaaacacacagttgcattgcatggttgtaaatgcagggagaagtagtcaatataaaataaaaccttgcatgcctaatcagctaaggttaaggataacttgtggatggtggagatctgacgtgtcaaagctccagaaacacgtgtgcatgtttgaaagatcgtcgacggccgatgcagtaacttaattccaaacattcaatattatttgtcttgtctttgcactgatcatcgactagctaggctagctgcttgcttaattcgcttgcttcgcgcctaattagcctctgccctttttacactcggacagtgacatgtatttttcagatgaagacgtgtatttctaaccgtatttgtacatgtatatgtgtatgcttatttgtacaacagtacaagactgtcaagctatctctagctggctggctggctggcttgtttgatgaccaatttgagaaatcaaagcgctgtgaaaatggttgagtggtctattgtatatcgtggaattatgttataaaatttgatggaaatattcagtttctcattttatttaggtcctatttcgcacaaggtttcagaactcaagatctggaatttttaagagcttaggcattactagctctagaaatctataaaaatctggaatcataattactagaaggaatcatttaattcctattttagaggaaatacaaaattttaaattgatttactccctcaggtttcataacttttaactttggacaagattgttggccaaagttaaagtcaaactattagagctttaaccattaatgatattcaaaatatttagtttgaaaacactggaacaagatgtatagaaaatcattaaaaagtattttattaaaattaaatatctacttatatatatatatattgtaatgaaaaattataatcaaaggtaggttggtatgttttgaaggacatgtgtcgttgttcaagacatcaagagttataaaaccgaagccgaagggaataactctataaattgtagaatgtggatctgggattttgatttgtgccaaacagggccttaattacttagcgtgcgctcttgagggatacgatggtaaattggtaatgaatcaaactatatcatttttaattaaataagttaaaccgatgattaactccaaacagtttgtactttgtttgcttcctgcaagttagtagagttatgcccggtcaaacacaggcagctttaagttgagccattgaagataaaaccaagctcccaaaatcgatcatagcaaacattcgattggttgagtcaatgaaaaagagggtcaattttgagacgatggcaatgatcaaatcagtgaaatcgccatggatagctgctgagttctgacttgtagatcaacactgaagtccgggtcactccatttgacagtctttttcattttcagtctaagaaggcaataatccatcttgatgatgaaaagaagaaacccccatttggccatttgcattgttctttatgacttaattagtataatcaaagatgtaaatggagattaaagctcttgctccctgaatctgataaaccatgcatggatttttttaattaactgaacataattatgcatgtcagagtgttagttcagaaacctagaatcacacatcgaacaggactcagtttctagctgattatcaacagttcaaaaccatatagtacccaagttgatgttatattgattcttgatatgcaaatttttgattaggggacatgcacataatgcacatcgctctgaccactgagaggctgaaaagggcttatatatcatcaggccatcagcccatcacacagattaatttgcttccatgctaggaataagtccactttgactcctttaaaagtgacccgaatctaatccttgaccctcaaccgtaaaactggatagaacgactcctcaaactattgaaaccggtgcaatttgactcccttagtggttttggatggcggtttcgctgacatggcgcttacatggcggtgttgatctagtctgtggtgttgacgtggcgcttaggtggcatttcaattagaaacatatatgtgggacccgtttgtcatacacaaaaaaaaattgtcatcctctctctttcttctcatccccctctttctcccttctctctttatttctctttctctccccttccaccgtccgcggggagcacgggttgaagcggcgacggggcgggggctggagtggtggtgaccggtgggagctgaagcggcggtggcggtagcgggctagagctaacgcgggtggaggcggtaggagaaggaggcggcggcgatggaaaccgccccacgccacagacctccaacgaggcggctgcggctgcctccgacaagcgcgttggattatccccagcctccgtaagctccagcccactgccaccgctgctccagctagctccggctcccgacgacgccgaaccaggtcaccttcttctgcgcctcgcccaacgtcttcaggaactcctcacgccaccggaagccgcactcccccatgatggcgcgcaacgtcaggttggttagcgtcccggtgatctgcctgctcacgttcagtgccggcggtggcggcgatggcgctgacgaggcgggcgacctgctcctccctagcggaacgagcgcaccttgccgaagagtaccccccccccccccggtggcgtcgatggagttcctcactgtacgcccagccatggaggtgggagcccccgggctaggcgccaggaggaggccgagctccatcctcgactttggccatgatggtatgcatgtagcaactcctgccttgggacgaaggcaaggcatatcatcaccttctcggcatgatttgtgatgagcaggaattagtaatcgagctacattggtgtacacatcttcttgcttgcttgtcttctcctgtgatgctacattggtgtgtttgttgtgctgctgctcgactctgccggctccgctccatacacctttgccggagcattgtgtgggttggtcgggctgggttcatggactgcatcctcggggaccgccaccatcaggcatgcggatacggtgaggttgaggtctatcacgatggggaagctggctcccgcccgctgctgccacgtcggccatcgcccgccgccgctctgactcccgcttgccgtcaccgcccctgcccgcagattgcgctatgagagacaaggtgaagagaaacggggagataaagagagagaagggagagagagagagagggagggggaagaagagagagtgtgaatgacgtgtggtccacaatattttgctagatatctgtcatcaaatttctccccctgatatttgtcgtttttctgaccgttggatttgcgctacgatgcgtgcaaggattggtttggatcaggtcgcgtgagagtcaaagcctggtctcgcggagttgtcaaatttcgatttccgcgccgtgttcatagacgttttcattttcttctcgctacttatctctttctcctcgttgtctccacgctctcgctctctctctctctcgttctctctttttttttctctttcattgttttctccgtcgatagagaagagagagagagccatctcgccgcggcgagagagagggggctcgccggcgggagagagggggctcgccgacgggagagatctggcttgccggcgagcacgagagagaggtagttctctcgctccttttcctttctctttttttttctctctcttcattgttttctccggagagagagagagccatctcgccggcgagagagagcgggctcgtcgacgagagagagctggcttgctgatgtgcgcacgagagaggtgggtcgctgtggagattcaactcaccagagagttttttttctgatttctctccttctctcctattcgatttcgttttgttccataagttttaggcaaatatcttcggtgatgtatactttcgtagatccgtgatttctatgtattattgatgagatttataagttctaggtgtttagtcccctgatcttttgatttataggcttagctacacattattaaaaatttctagtgtagtttttatttggttattttgtaagccaacgatatgatattttttgagatgtgcttcagtgctcagggatgttttcctgctcacaaatttttatcaggtgcaagtgtgtgtagcattttgcttggattcaggtgcgaattgagttcaggagggagaaacacattgttgcattttttatctgaatgctgcatttcgtttcagagatgcatgtactggtctgttcgaattgtaaatttttgccccaaattgtttgctgtctctgctcggttttcatgcagttagactactcggtctacttgttggcatgtggctcaattcgtttgtgggattccagtccaagagtttggttgcagattggcaaacatttctcagtgctcaaactgaccggggatgttttcctgttgaatttgtatgggttacgttttgccttaattctggtgtgaactgaacagagaagggaaagcatctgttgcaaatttatctgaattctgcattgcgtttcatagatgtatggactgattagtaccgatgaccaactgatcatcaattgtttggttcagttctcaacaataactgatccttctctgttgcaaactgatccaactacctccatgtttcatattttgcaaactgatccaacttgttacagaaaaataatcagttaattacattactgattaaatttttaattattattttcagtaatttgtttagatggctcgtattcacaattcaactcttggcaaggatccgattgatattagttgcatttcattctcatatattagttgactaatctgtttggggatctatctctggtccccaagtatgtcttgtgttgccttcttcagcatattaatcatttcgtttcagagatgtacagcttgatttcctagtatgctgagttgtttggttaaattaaatccaatcccctgcatgcattttgccttggttcttgttttgttactctttctatgtatatgttgttctttggttcagaatttgttgtgcatgaacaaggaaagtagaactcgtatgaggctttcaggtatttaaggctggcgctttgatttttgtctctgggctagagtggggagtcttggcttcaactttttttcttttgctgaatttggtgttctttcaagttaaaaatctggatggtttttcagtgcttaccccctttccagtagcctagatttgtgactgtactttgctcttggtcagctttagggtgatttttttttgtgttctacattggtaattaccggtgtgcgacgtggacactgttttttcttatttattttggatttagccctgtaggtgctgctgcttaggagttctacttcttatcctggagatgtactgtctagttagattaatccatcataaagttgacatagtattgtttgttaatgacattatagaggccatacaatagttctttgatttattttgtcctccctgaacatgttttatttaattacatttattcgtcaaagaaataaatgtattcttcatttttgtaaagcatgattgtacttactagtctttcattttcattaagaaatatgtattgatcataaagtaattgtgctttattttcgccaatctctgattcaattgtctctgactttttgcctttttcaaaatcctgcaggtaacgagatcctggaactgaaaaagaaagcataattaattagtcaaaatcagtgtaagtattgcaaaattttccattatgactgatttatttctatcatgcttgctataatcaaaattttgtgtttgccatatgatgattaataacatttgaattaagcaaatctaagttctgcacgtcatcaagcgagaaaattaattatcctaagtaaaaagaataattaaatttcttatctgatgattgtacagagctttgaggtgttttttttgtttaaatctgatggcatatttttttttatgttttgacaccatttttgaggcatactaatgcattatccatagcctctaattcttcatatgatgttttttgcttaatgtattcgacttatagtccaattacagtccatatgcactgtaattacagttgtaacttctattatttctcactgtaactgaatgcaggtagttagattatttttatttatcatgctttgcatctaaattttgccatatataaatttgtgctagatgtaatttttgacaaatatcagagatggtgcataataataggtaagcatgatttttctaaccttcaactgtcttcttgatttttaattcttcagactcgattatgtctcttatacatgtctttgattgtgtattccctgtaacttaagcatgtaatctatgacatcctgcatgtttgggtcattttatactatgttacaatctggaataatgttgattctatcgaaagagtactgaatttctatgagaaagttaagcatgattccagttacagtccatatgcactgtagttacagttgtagtttttgttatttttccctgtaacagaaatgcatgtataggttatatgtaatatatttttagaacatgttagaataggaagtaatgcatgagtactgaaatttctgagagaagctacagtaggaattaatgctgatgttattgcgttagtactgaaatgaaaattcaacacaagtatgttcggtgcatgttttgtgtttatataagtacttaattttttatttcatttgaataggaaaatctgcatatagtttagtgacataattttgtaattatgtcattagattctttgcagattttgttgctcaaatgtagtcaaaaattagatctgttatagttcaactttagttgcatagaaagtttagaatgctagcccactataattacaatgtttcaatagtatcttgaaagattttgcatgaatactgtaataacaatgccattctaatctggaacaactttggtgttctgaattttggtttcttcagtatgttttgccataatattgctcttatctgattcttggctttttttttttgcacatcttgtactgcttcatgaccagcaactggagaaaattgaagttttcatgagaaactacagtgttatgtttggtaagttatgaaagaaacatttatacttgtttttttgtaccttttatctgtattggttcttttttcttggtctgcaacttgatgtccttggttgtttctgcagctgaaattgttcctgcaaaatgttattgaaagcattacaaagcatgttagttttgtatgttctaggaaatctaactaattaacctaaatattttggttttcatatgctctaggtaatctgactatcaaacttaaatatttttgggtttcatgcagtctaaaattatagtaattataacttaaaacatacttacagttcaactcatcaccacttacagtgcagttacagtcaaaatatacctcacttacagttgtaatttctgttatttctcactgtaactagctgttggtagttagagcttgtaattgattgacattggtttattactgatttgtgtgaaaactaggacacttgtagtttgggaacccttgggactcttttttttttggttagttgtgcatgcaaaagttagaatatgtgtgcttttagtttcataaaaacatagtgagcttgtaatgcttccccttgtgttctaggttttttttccaatcaatgcagtgtatggtaatcatccatttttgaattagttatatgttttactgaaatttagctagccttcttgcatcattgcaagtgtgaggccatttcatttatgttgtctgttagtgtatgcaaccaacattaattttttttctttgtctttgcatagattctgattgagtgcttcctggacataactcttatttgtgtactaattcttttcattcaaatagaaaaggagaacttgtgcctttatggtttattagtgctttttatttctgttgcagcgtttagatgttttctcttaggaaaataccctagaaaaatatatctcttgaggcatttgaattgctgatctaaatctgtatatgatgcccacttcttacatctagtgatttagttaagttgttttcaaatggtattttgagttatgaattttgtttatcagatgaagtcaatattttaggtttcatgtagtcttaaaacacacttacagggcaactcatctccacttatagtgtagttacagtggaaatgtacctcacttgcagttgtaatttctgttctctctcactgtaactgactgttggtagttagattcctcctattttagctccaaagttgtatccattcaataactaccagttactttatgctcactatttatagtctttccctgttgatttgaccaatttagtggtggaagcttcgcattcttctcgtcaggctagcacatggctcatttgtgtgctaacttaggctaaatcactagagagcgaaactttcactttgtgcaaatatatccagttggttgctaagagcaatcccaaatttgatggttctgtatactcaaattggctgcttaaactaaaaatataaatatctcaaaacactggtaaaccaaagaccatattgatactctactttttggatagattataactctatccctgcagaagtgagattcaagtctgtttgttgttaccttaaaacacacttacagtgcaactcatcactacttatagtgcagttacagtagaaatatacctcacttacagttgtaatttctgttatttctcactgtaactggctgttggtagtttttgatattggttttatcagtgaattgtgcaaaaactgagggacttgtagtttagggaaccctaggcatcttcatttttttttatctgtgcctgatatatttgtttttgctagttattaatgtaggcctagttttgtactgttattttctattatctgtgttgctttgtgtttcatgcagcaccatccatcactagtataacttaaatatacttacacttcaactcatcaccacttacggttcagttacagtggaaatataccttagttacaaatgtaatttttattatttatttttgtaactaactgttggtagtttgatcttcattttactttctgaacttgtcacggtgtccctgtcaaggtaccatgtatatgtcgaatctagggaggctgatgccctgctagatgggcatttttatagttattatgaatttttagttcagagttaattttggcatataggactatatgatttcagttctttggttcataaagaaaatttttcgtgcacaaagaaaatccccatttttgcagatttctcgttgcatatgctagcagtttactgatgcactgttttctgcaatcctgacaggtgctgttcaggaagaagctgagtttcatggtgtcatttcaagctcaacatatgagatgtgctcctcatttgatcaaattggttgttaaaggttttatagcaaatatcactgattgaatgagcttgtaaacttgttttttttgccaatttttgtgagattccattttgttctctctgtgcacacatggcttccctctgcacacatggcacaatacaaaatttttaatgaagttctgagttagtaatggcctagttttgtactgtgcatatgcactgaagaaatagtgctgagttagtgacttgagactgaagtgtgcagtctgtgttcttcagatatgatgcggtttttctgaagaatgtaattcttttacttctgggtttactgctcgaatgtgaacttatgattcatcttgctttcgaaatttgaagctgtaatttttgcattttatgttcttggtaggaggtaattggattgggcgtgggattcactgaagatttcattattttgactttgatttatctgaagaaatatattgttgcttcggtgatttgagactgtaaatctgtaatatgcattttgttttcttgtttggaagatgtaaccggattgggtttggaattcactgaagatttcacatattctctatcacttatggtgtacagtgtgctatctaaaagttgtgtatcatttcctagctaattgtaaccatgaagttgtctatttaaataatgtagggtgcaagcttgttgtatttttactcagaagaatttttgagttctcaataatttgagcagatctggactttgttcttatctagaaactgaagaacatgttgactacttttgttctcgttgaaataataaacagtgaggtgtgtgaggtaccaaaatgatagccctagtttataatctaaataaatccccaatttcatccatttctgacaaagattagaaatctgacttctgtttctttgttttttttcaagatttaggatgaaggcaaacagtgaatgatttgtgttgaaatttccagcaaaaaggcaaggatggatgagtggtaggttcatatttacctgggagtttggtttcttttgttagtttcatcttcttggttccatcttcttgatccatctgcttgttcttctttttcttttcctcctcttcgtccatggcttggtcgcctttctgttcaatctggtctttctcttgcgtgttctttttttctcttatgccgtctccgatcgatctactagctaagctgttgcgcgtgatctgtttttttctttttttaatagttttcttggattccaagctgatatggctgtgtttgtattgggctacgatgtgatattgggctggcataatcttatcttccttttttggccttttttttatgctatctcattctgggctgagttttaatttttatgtttgatctactcgtttgggctagttttgaagcccaatatgtttttttctttatttattttgatccaatacgagaaaatttggttttattatttttttccttgtccattggatgcgtatccgagggcttgaaaaaagtgggtgattttgccccaaaaatctgtcgacaaacagatagctagttcccaacgtatttttatgtgtgaatcacaagtgggtcccacagattttttttaattctaatgccacgtaagcgttacgtgggacaaatactaggtcaacatcgccacgtcaacgccacatcagcaaaaccgccctccaaaaccactaggggagtcaaattgcaccggtttcattagtttggggagtcgttctatccggttttgcggttgagggtcatggattagattcggatctcttttaagggactcaaagtggacttattcctccatgctaagcctgcattaatgatgggcccggatagtagctttcctggcccggcccatttcggcctcacagatggatgatgacgcgtgcaaactgcccagtctctgaatttttcaaaactaattttcaggaagaaaaccaatctagaattccggaattgtcattcaactaattattagctccaacgagaatttcgcacgaaacaattcaattagtattcaaatcatttttctattctaaaagaacacgcaaaaaaaaaagaaggggagttaagtcgttatacttccctttatttctcatcttttctaatccaaccgtttcatatttaaattgttttgacttttttatagttaaactttttcaaatttgatcacatttatagtaaaactagcaatatatacaacaagaagttagttttaacattgaatatattttgataatacgtttattttgtgttggaaatattgctatatttttctataatcttggttaaacttaaaaatatgacacagtatgaaacagagggagtacttttgactacggatgcaagcgggccaacccgcgggtctgtttatagacaaaatttagcaggtaactcgcgggttacctactaatttaacctataaacgggtttatggattgacccacccgcatctttagatgcagcaaacaaggccacgacacgaaaacccacggattatcacaaatttgacctataagtgagctcgcggatcagcctgcttacatccctactttttgcaccatctttcacctttttcataagcaaagcaaaacacttgtgaattcggttatattagccaaaaaacaagaaaacaaaacctggccccaccagtcatagcatctccaatccgggcccacccgacagtgacactccatcatcatgacatcacgagacgtagcctctcctcttctcccttcccttcccatgtgaaatctcgccgtctcctctcggagcctttcctcctcgccttctcccttctctctctctctctctctctctctctctctctctctcccgaaccttctcgccatggccgaccacgctgcggcggaggcggcgccgcagtcgtcgcaggaggaggaggaggactggaaggaggccgaggggggagacggggacgtcgaggtggcggacaggggcggcggaggcggcgccgccaatgggggaatcccggaggggaggccgatccgggtctacgcggacggaatctacgatctcttccacttcggccacgccaagtcgctcgagcaggccaagaggctgtgagaaaccccctccccctccccttctctctcgtcgtagtctcgctcactcgattcgatctgcttctcgccgtcatgatgatgtcatcatgatttgaagtattttgtatggagtaatcagaggcagtttttgtttttggtctggttcggcgtgagatttgagcgagaaatgttagcttttttagttagggtggggaatctgacgccattattagcagttcaaccacgtcctgcagcgatttgctatcgtttgttgcgatacttcatcttaatagatcgtttcgttgattcttagtagatcgtttcgttgattttggtgtaaaaagtgtttttactgtcgcgctgccgattaggaagtagtctgatgatgaatcttgctgtagataatcctttctgagaaaaatggatggatgttaattgctggtgttttcgtgcttttgtcatgtgagggacatgcttgagcaatctcggtatgttttacctaacgtgatatcactctcggatgtcctttcttgtttgccctatgttggatcattcagagggaaagataaactgttcacagattccttttcaaataatgcggtttggtttggcattatttgccactctctgtttaatctgtacggtaatcttgccttgtttccttttatttgtggactaaccgggtttattggttggatgcggtcaaatcagtctgctctaaggaaatgtgcttatctgttccaaactagtctgtgattttttgcccattacgaagttcctcacacatatatcattcacagaagaccttttgtgttgtgggatagttacttgtttacacgaaaatgcttttgggtactaatggggaaagtgcagtgcatgacttttctgtggcatcttttaacttttacaaggaaccttgcatttgcagtcatgctctgtttcttaagaatgaagccgtgtttctatctttaaaggctatcctgcatgatcttgtgaaagattattttttttatccaattgtacacctcataaaaaaaactccaattgtatactctcctacttggagacacgtctttttccctatatgttccatagattttgtgcatacttagagccacctttttcatgtatgttctgaatagttgcagccttgttaaaatttgtattcaactactatatagaaatttatttactggatctattgcaatacaacaaagatgttgtttaaccgaactgccttcaataatttaggtttcctaacacatatctccttgtcggatgctgcaatgatgagttgacacataagtacaaagggagaactgttatgacagaggatgagcgatatgaatcacttcgtcactgcaagtaatcttgtcttatgctttgttctagtcaataagccaccaatattatatctttctttagttcttttagttactatactatgataatacatatgctcttcttttcctaggtgggtggatgaagtcattcctgatgctccatgggtggtaacggaagaattcttgaataaacataacattgattttgttgcacatgattctctgccgtaagtgttcttaacagatctcgatgtttataacatagtaatcatttctgatgtacttgttgtgataatacatatgctggtcttttctttctttacataatatatacagagcctttgggccttcacagtgatggatctgaaattcaaatatcattatctttaattaatatattcaccttatttttcctatttgaatatacaggtatgctgatgctagtggagctggtaacgatgtctatgaatttgtgagccctaatttcacgactgttttcttcaattacaattattgattaaaattttgtttgtcgtatctagtaacagttattatttgtgtagactggcatatttctgacagagactaatctcgttgtgtctatcaggtcaaaaaacttggtaaatttaaggaaacccagcgcacagatgggatatcgacgtcagatattataatgcggattgttaaggattataatgagtatgttatgcggaacctggccagggggtacaccagaaaggatcttggtgtcagttacgttaaggcatgtgatattaacctgacactttcacctcaattccagcttgaataggttgtctttatattttaacagtgctgcggtaatgttttgaactggccacctgatctttgatacatcttatcaggaaaaaagactgagagttaacatgggattaaaaaacctgcgtgacaaagtgaagcagcaccaagaaaaagtaggggagaaggtattattcactatcttcctaatttatgtcaaagtagggtttaacaattgattaactgacagttttgccatcttcgtatctctctgtgttgatcactggttggttaatgcagggatactttccttgtgtcattttactttgataaacataattctgaatgtgacatgtatggcatgtaaagtataatcttttctggatagtgttttgttggttcaattggtagacttttattggaagctaaaaatacgttctcaagcttaccatgatgatgatgctacatgtccatatcttcagtttgatgtactttctcttttctagttcaaaattaatcttttggtggtcaagacttttctcttttctagttcaactaatcttttggtagtcaagacctagagtccaaatctgatatctgtatcttgtacactctcctacttcaaacaaagatactaatttctcctactaaagttgctaattaatatttgggtcccccctaatcttttctagttcaactagtgttttgttggtcaagacctagagtccaaatctgatatctgtatctagtacactctcgtacttcaaacaaagattctaatttctcctactaaagttgctaattaatatttgggcccccctaataatattttggtcctacaaacctagcattccctctgaaattaacctgtccaaatgttttgaaataaattggttattcgcagtggaatacaatggcgaaactccaggaagagtgggtggaaaatgcagatcgatgggttgctggttttctggagaagtttgaagaaggctgccactcaatggttaatcactccctgccacttagtagactagaacttagcatatgattcaaggaattcattgctcacttcaacttgctttaaaaaaattcctcagggaactgccatcaaagagcggatccaagagaggctcaaggcgcaatccagggatttcagccttctacagtatgatggcgaggatgttgacgaggatgaggacgacgacgaatatgtcagagaataatgccaccactgtgaatatacgtcaagtataatatatgtacatgcgctgcatgtagcagatcttcaatccttgggcatgtcatgcacccctctctcttcaggaatggtgaacttgtgccccccaggttagattttggtgctgtgttgtagcaatagcaggtgttttgtttaggctaagacgcaaagtaagcctgtaaaatcccctagtcgatggcctgaatggttatctggaagatacagatatgttcaattatatttttgtttagcacacaagaacactatatttcaattgactatctactatatttcaattgactatctactatatttcaatcgactatctttcatactttttgaacataattaagtttcctaggtccctacatggtggtttttccccatagttcttccagggaaaaaaaagaaagaacaatcttcatacatataagttttaagttttggttgattacctttgccttcgctttttgtacgtgtaatacttgtatatattcttaactgcatttgttattattttcattatatttttgtctgctggactatttaacattgatgtgaaaaaacacgattgtgatttgcaattaatgcagggaccaatttgcaaaatccagggtcgctaccgatagtggcgatcatacgtgaatagggatgaaaacggtcggaaacgatcggaaaacagcctcaaccatttccgtaaccatatttttctcggaaacgaaatcggaaacggtaaagtcggaaacgaaaaagatatcagaaatattggaaaaccggaaacggaacaatacggacgaaaacatgtcggtacagatcggaaactggtaacaaatacggaaacattaaactataaaaacatatatttaactttacataagtatgttatatatatacataaattcaagcttatactatataaattataaattaacttcattttagccatgtacaaaagttagagattttattgaagagtcattcaatctataagctgtgggtcaagtatagacatgtcctataatatcgacatatttagaatacggtaattaccatgttataagaaacggtaatttccgcaagaatacggtaaatacggaaacgatcggtataacagcaaaaccatttccgttttcatttccatattttttaccatttccatttttgtttcggtcgattaccatttccatatggctcggccggtagaaagtcgaaaacgaacgccggtcggccggtaattaccgttaccgttttcacccctatacgtgaaggcccattcgtcgttcatcaatattcaatgcagaaaaggtgtgtcgctatcaacgatgctgatcctacatagagttcattttaaaaacaaataagatccagaaattctcgttagcttagacaaggctaacgacagataccagtatacaagtccatagacgcaagcaaaattgacaattttcgattcgagactatttagagggtaaaatcaggccaaggtcatcgggccatagaccatttattataaacataagctaaattgacaatcgtcgagactatttcggcactctttcctacccatctctatcgttttctgcgcgcacgctttttaaactactaaatgtaacttttttaaaaaaaaattatatacgaaagttactttaaaaattgtactgatctatttttttaaaaaaagctaatacttaattaatcaagtgttaaaagatggttccgttttatgtgtaggagggatgggttcccatgcactgccgaacgcagctgcaaattaaacggtcactgcaaattctctgccttcatctcgcatgcgagatgccacattgatatcgtccctatacaagggccattttgcaaaattttggatggtaccaaccggggcctttatacaaaaataccatctcgcgggccgcacgtgacagtcgggccttagtgggcttgggcctaaaatgctgcacgggccacaaaaccgcaggcccactcgggcctgcttctcccccatgtccggcggccggagccggcccgacgagcccgacgccgacgccgcctgcgctggccgccgtcggcgacggagcggcatctctgcatctcgcgagtccgtgacttatcgatgattgattccacttcaggatacctcgaccttccaactcgccgtcggccatctccggcgactgacggcggcggccgcgcacgcatgcggaccatcgatcaagtggtaatcacgtctcaaatttatcccttttcttttttttttctgattattatgagattattatgaaaccgaaaaccatggactaaaaccaccggtatcgaattccactgttccccaccaccaaccccacccccagtttggccaaattcccaagatttatttggccaagcagtcccaaactccaagatgaaatcttggagcttccaagggttaaaaaaaccaaagccttcttcttgggttcctttcctattggctgcaaattcatcgacaccacattgccattggagcagcttgttgccttcttcagactcttttcttgaagtttcagccaagaaagtgagcgaggccacacaagttcaggtgtgtgctggggccatctggaattgaggtaaattgatttgtttcttgccatttccttgtgccaggaattttggtatctctttctggtgccttattctgattctttcatggctcctacgtttgtttttgtgttcttgctgacgcaggcggccattatttagaggcgaaaggaaatgtctgtctctttcttgtctgaggacttgaggaggttctgatacatgcttagtttcatcgatttgtttggcgctttctttgtgatctttttctcggactttacatttgtttctgttcttgcaggcatccttaggagcaaacagaaatatctggtaccattctgatggatatttccaatccttgtgttttaatactttgaggtaatgagacgtgatttacgctttgtgctctttaatgctggtcttaaatagtggatgttgtccaatagttcaacacacccctcatttttcttgtgaagcaagtagacagatacattagatttgacttactcctattttcttgagaaaaaattggggtctttaaatattcttgcttggattgcttgaaagagtttgctcttcctttctgggaatggttgcctcaattcggagatttacagatttatgggttgctttcatagtggtggtaacttctttcttgcttttgttttgccctgtagttcaagtcactgatgttataagttagccatgaattattatatggtcttgatcttctctcattactatatgctgctcttattatttcatttgcaatgagatttggttgtcagaggtatggtatgattgaactcctagttctaggtcgcggagccgatctttgattttctttttttttagttattcagttctgaaaatagttggtcaggtcccattcttcattattcccccctgtcaaagtaattctcaatctgtgcagatcctcgattatgtcagctattttcagtttacagtggatatgcaaatagccaattgcaggttgctcctatatattaatttagttctgcattctgcagttctttatgcttgatatttgcaatctgatttcccatacctacaaaatctttgtggcttatactggtgaatacattgacagtatgtaatccattttctgcagtgcagaagacaattaatcctttgtgacaattctggatgaacaagcagatacaatttgtcataagcagcagtctgaattcttgatcatcaccaaaaaatgtcgctgctatcgaagctgagattggtcacggtggatgtgacaggaaccctgatagcatacaaggggcagcttggtgattactactgcatggcagccaaatctgcagggatgccatgccctgattacaagcggatgcatgaaggcttcaaggctgcatacaccgagatgactgtcagacacccttgctttggccatgcttccaacatgcccaacatcgattggtggaagatgtgtgtcaaggactctttcatcagggtaaacacttcttgtaatcttccaaagaaatgacttttttcagggggaaaaaaagaactttcttttagatgcattgctgcaattctctcatcttctgcctgttggcttatcagccacagccaaattgaattttggagctcaatttcaaagttgattcgtggtttattctctagcattgtttttctttactctgcgaataatacagatataagagttttactcgcaaattaatttttgttgcttcaagagcagccaagggtagtatacttttctagcttaagaactgatgaaaatgttgtaatcttgtctattgtttgacatggtgcaggctgggtatgagtatgatgatgccacatttgagaaaatattcagacggatttactccactttcggttcctctgcaccctactcggtgttccctgatgctcaacaattcctgagatggctgcgcaacaatggctgcaccgtcggtatcgtcagcaacgccgagtaccggtacaaggacgtcgtcctacctgcacttggtctcaatgaggtaaattctgcaaatttttctgcagatattatcagctgattaatcgaaccacaaaattcacaattactccgacagataggtggcatggcatttgccgttcttgttttcgtttttagctgtatgtgtgcactttcgtggtgtagaggtcgagagtatacttaaaattttctcaagttcaataaaacttccattatattaagaaaattcagtgaatttgaattgctcattctgatgctgatttgggtgtgtttgaactctgaaggggtcggagtgggatttcggggtgttctcggggatcgtgggcgtggagaagccggacaggaggatgtacgaggcggcgctggagatggccggcggcgtggcggcggcggaggctctgcacatcggcgacagcatgcgcaaggactacgcgccggcgcggcgggccgggatgcacgcgctgctgctggacaggttccgcacggccgaggcggagggctggcggcggtccggcgccgccgtgctccccgacctcgccgccgcccgggagtggctcaccgccgccgcggcgccgccggcgacggcggcgtggaggaggagcccgtcgtcgcagctgaccgctgagtcgtctgaataaattgtaacgcagcgaccaagaatgcggtggaaaaaaacatgtggaatttcacggcaagtttggatgcaaatcgagagaatttcacggcaaatcgaatttggtttgccaaaatctgtgtcgaagacttcaaattctctgttgtcacttttgtggtgttcggtttctactgaaaataaagattagttaggacacgaaaataaaaaaaatatattagtgtaggattaattgagtttaattattataaaattaaaaatttagatttttttaatattttaaaacagcttttataaaaagtttttatacggaatacaacatttagcagtttaaaaaacatcctaataaaatttaaaataaaattttttctcaatcagaaaaagaacatggcttttatcagcaaaaagttagggaaaactacaccaaagatggttatcttcctttttctttccaaattcgttgtcaaaatcacgagtagtaaatttcgaattcacgaaaatttctttcaaataaggctccgatactccgaatttcttaataaaaaaaagagtaaccattaggatgggcccacattacagtgacaccgcgatatgcaattgcaagtcgaaatatccatccacgagccttcgccgagccgagttggagaaggcgagcgatgctgcgcgcttgcggcggcgcgtcgccggcggcggcggcggcggcggtgcccgcgctcgtcagggcgcgcctcgcgaagcaggcctcctccgcagcccacgcggccgccaccgccaccgcctccgcttcctcctccctctccgcgctgggagaggtcgccgccgggcgcaaaggtctagtctagtctctgcggcattttgccgaacggctgtcggtcgcgccgcgaaagtgtcctctcccatcttgcttcttctgattacgcggcgaaaccgctcgcgccatggcggttgcttgcgcttgcggaaatgctcaagtggattgtggctgcatttacctgcgacgctgcagttcgttcttgttgagtggctgacattgatccactcatcgtttgattcacctgtaactgtaaccagtaatcattaatatctattgttaattgtagctgacttccagaagcatatttgctttgttgaaactaattgtatgagaagcgaggttttgtgtagagatgtgcctaatcattgctctatagaactaataggttggtcctcattaaccctctagagtcaggggttagcaattctctagagttttttttcctttcggcataatgcagagtactctggtgttgcattatccataattataccgttctgtacagtaagtattatgaagtggtgatagtcctcttatgtcaaaaatagttttatgtctcctagagatggctcataattagttttggaagttttaaatcattataatgcctaagcacaaagtggagttgaattttccaattggaatgcattgtctatttgttgtctagatctctcttgtattgtcaaactggaaataaagcatagctgattcttccttttttgggttaataataggctatggttaggagctactagacttggaggctggaatcttttttttttctttcacttgagttgacataaagactaacttcaaacattttttttaggtttggcaagagtagtattaaagaaaggaaagacccaaatatttcgagatgggagtccgatggtgtatagtggtgctgttgatagaataattggtcgacctcctccaaaaactggtgatgttgttcttgtagctgatggggcagagaaacctattggatggggtctctataactctgtgtccatgttttgtgttcggctgatgcaactagaagaagaggcaaaaaggtgacaaggtcacaagttgaagttctctgtttacagacaatttgagaacatggcctaatattttccctattttttttgtttacagggatccaacatgtgcactaaatatggaaagactgcttgaggcaaggattttatctgctgtggatttacggcgcagtttaggtctcccttcagttcacacaaatgcttatcgtctcatcaacagtgaaggggacaggtatatattattcttgagtctcgacttatgttatatggtcaaggtcaccaaaggtaccatgtcaagatcaatcatcacaagaagtgtaatcagtgcagaactatttggacttctagttctagagtatatttgacctccaaaatccaaattgcattgttccaatatattcgcacgaagaataatttttattattgttttgaaatgcagattgtctggtctaatagtggatatctttgctgatgttgctgtagttgcttcatctgctgcttgggttgagaaatataggcatgaaatccagttccttgttaacaaagtcagtgatgtgaaccatataaagtggagatcatcaacagatattctaaaagaagaaggattagatgtatcagaacaaaaggatcctgaatcgtcttcacactgtggaacagtggaggtgaaccaacttagtaattattgaaacaaagccattaaatttggtttacctttattactaatttcaagagagagatggcattcatgcactctattcagcacatcaatcagcttggtttttcagatttgacaatcttttcttcttcctatgttatgttgcctgttgttccaacacctctcaattgctgctcttactttcaggtcatggagaatgatgttctctatctagtctcattggaggggcagaaaacagggttttatgcagatcaacgtgagaaccgtcatttcatatcaacactctcaaaggaccaaagggttcttgatctgtgctgctatagtggtggttttgctctaaatgcagcaaagggtggtgctaataatgtcattggtataataccatatgctagcgaaccttttagtcctttgttgatcttttcatatgcgtcaattgttcaattgaatcattgatcatgaaacccacaaaagagtataacattatacatgtttggctgctaaggaaaatataattagtgtatcctttttcaggcattgattcatcagcatcagcactagaccttgccaataagaatattatcctgaataagcttgacacccaaaggatttcgtttgtaaaagaagatgcgactgcattcatgaaaggtgctatctcaagaaatgaggtctgggacttggtaatccttgatcctccaaagttggcacctcgaaaaaaggtaagcatacaatagagcatttaccattagtctctaatttgacttcaaatgagatatcttttcatccatggatctgaagtggcaaagaatgttacatatccagcagttcgcgaatcttcgatttcttatcagaagacacccaaagtaccctttagcatatgaacatcagttagcttctttggctggttgaccctagtttactgttagtacataatccatttggccctatataatcatgtctgttgaagcatctgtataagttcattgagggtttccaatcaataaaatggaaagtgtgcagcagaattttgaatcatagtattttgcttcaaaagaaataaagaaattaagtaaggagcatgtcttagatatacctattttagaggaagtcatgcgctttatgggtacttaaaactttagatgggtgaacaagtcaaatagaacctctttataagaccagacggaatcaaatagaacctctttataagaccagacggaggatctggttccagtttaccaggtgtttaccagaagcaaaaaaccattggttttctgaaacttgagcttgctagtgctctacttttagtaactgcttcgattattatctgtcctgttgtatttaggtgctacaaagtgcctcgggtatgtacagaagcttgaacgctcttgcgatgcaagtggtaaagccaggggggttactcatgacatgctcatgctctggagctatgacccaaagcggcctcttcctcagaaccattcaggtatgtcttttgatcatgttgcataaccaagtaatcagcatacaccttgtcacccatatgtatccaagcaactaacaccttatagtaacaataacatcaattgaaaggaacatccaataatggtccaatctaattatttccagcttgacaaactgtaaacattcaacagaaaaaaaattggacaaaacacaatgcccatatctagcttccaactcaagatttccctttttttgggtagaaggtttgcaatgtaaattcatgccccattccagccgtcatattggctataggtccaaggtggtaaaattgttttttttttgtaatgatacatattggattcaataatagtgttttacatcggaaattgccatcaagttatgcacatcgatgataacattatctcttttgtttttaatttcaagggtgctgcatcaatgaccggccgaaaggttacagttctacgccaagcaggggcagcctgtgatcatcccgtagatcctgcataccctgaaggccgatatctcagcaattacttgctccgagtgacctgaaggaaaaaaaaaaaggcttagaagccttctactgaccaattaccgcacagcattttcctaagagctgatgctttgaagttatagttcagtttcatttcattttttaagtcatacttgttagatcaagaaactttccgaaggaaagatgtatgatgatatagattttgaagattatttgttaatttctagcgcagatcattatttacccttgttgagattaacgtttttaacacttttttatatatggaatatggaagatgtgtaaatcattcacatggtgacaccagtgcaattgaggtaacaatggaatcacactgcaacaatataaaaatcattccatttaacttctgggatatttaaaattttcaacaaaagaaggctgtatatatatatatttttctttgcaacataatgtacatcagtgttgctcataaacgctgccctaattggtataagccgtattggcactccagcacggctaacaaataaaaccgctatctagtacaagatacatttgaatccataatccaacttgcttcatgttgaatttgcaacttaaaagtttgaagagcttattaacggcctgcagggtttctgttccatgacaagtagttgttgtcacccattttcctgaaaaaaaaagaggaaaattagagatgcaattcatatcagtgaaatgaagcagttctcaaaggccatcacattagctttaataagagttcaatgaacaaaacaacaaatcgaactcatttccacgcattagtgtgtgtgtgtgtgtgtatttttttattttatttttttttttttgggggggggggggggttctaaatgaaatgatgtgcaggactcctgcgtgttctgagacaaccaaaaaaaggctaagttcagtttgaagacacattgagcacatgaagcactgatgaggatttgtagcctagaaagggctcttttggttggttggatgaggatcaactaagaagaatttagttcaactccaaagtagctggtcaccaaacaaggcctaacaatgcctcaattatccccagggtacatgcgcttcttcaaatgattgcattacatgagaattgagaagttactcaccttggttttatcaagtacagcaaggtgaatgcaaatgccaggaagaagcagagtccaccaacactgagatatgctagaccaagaaaatcattctttccaccgagccatgtcgaggtagaaagtaccaacttctttttgccactaaagctatatgtgttgtagttgttctccaatgtcaccgtaatggtgtcacctttcttgaggtcagtgtgtatcctaccatacagctttctgaatgttggaagtgcagcagttctcatccaaacaataaggtcttcttgtttactcaactgcatagaaagtaaataaatgagtacttcaggtaaatactattattctaactgctcagagaattttcttgatctttaaatgggattacacaaaagtactaaaagcataattgcatgtccaatatgtatgtgataatctaccagaacagagaacataccgatttatttggatcaagtgtttttccacctataagagaaccattctggaagttctttggaaagacatcacgtccaaatttgtgctccctgtcactcttccaagagatgtttttcttgtccactggcaggttcttactgttgcgaacaaagccatatgtatcattgaatatgctccatgcaatcagaccacaaggaacaattgccattccatttgctgtaccctcgggatcacaagtggaggtgtcatttgcctttttgggatctcttagctgtgcatcactccggctcttgacatatctgtatgaaaaatataattcagcaagaaaaatgtcatgcaaggcaagaagaattatcatttcctaaacgcaaaacaaaagggcgagcaaatcaaaatgactatttccaaaatcaatagtttcttgccatctgtacagtagaggcagatgtcaatagtgcattcataatttcatggcttctaccagagatatattttcccacttctaccatgcataagatatccttttctttgagaaactgacttagaagatacatcatattgaggttgagcattataccggcctaaccaaaatatattgtgtatatcatgtagccattgtattggcttggtactgttcgtgcactactgtatttactgtaccaacagcaaactattcaaggaggacctgctggcgcggcactagttgtaattaaacataagaatgattagttttttagatagttgaatttatttccttataggtatagtccgtgtattagagatacagcttacataaaattttcttagggtcaagacaagtcttcccaagaaaaaataatgaattcataaggttttatcatttcagtcactaattcaatctctctgcactcctcttttctaaaataataatatccttcaagacattgttcaacccttcctctgcatggtagcaggcagctacctcgtgtgaaccagcattcacaacaattcattctgacttaaccatttcaacagaactgctgcataaactggacatatatcccatccaagggtttatttgtactgatagttgaaatacttgtgacatcagaaagtatatttgcatacctcctatgattctgataaaagttatccagctggtaatacacaaagattggtgcatccatatcctttggaacctggagtggagaccaaaattcgaccaaatatttcagccaaggattctttcgatacttaaggcaagatgcataatttcagggtatagaagaatatgcatgtagctaggctcatttaccttaagagtccttctgcagtttttgcttattgttgggttctggatgtaagcaagcttgtcagttgtattagctgggacacatgcatcatcgtatcgatcaacaatctcaacaacctacagcaaaggaaaaatgttagcaaaaaatgatattcacgcttggccaaacatattttgaagttcgaataaaaaatacagcatacctttcgtgaagccttcaacgaaacaagcccgattgggacaaaaatgactccgacaagaacgaaaactgaaatgacctgcgtaagataagcacaagcatccgtcaggtgattaaacatgccatctcactcaagctaaatataactaacagcaggcactttttttgggctagtatcagcttacccattttggagtaagaatcggcttgcaagctgggagctcctgctgagtaaacttggaatctgcacataaaagagggtaaataaagtaaatttcatagcgaatttaacaattccaccaaaacaatcatcccaccatctgaaaagatggcagaccattctaaattgcaaaggcttcgtcgatgactcaaaactccagttctaaagtcaaagccaactgctactattgcagataggaagaacaagaactttttaaaaaaaaaaatcctataacaataatgtcccagtctcgaattgaaatctaaattatagcatcacaactttcagtacttcagccaaattaaaccttacacataaaacatctaaacctcttcaaactcatataatctactagtactagtatatcacaaaggatgaaaaaaaaaaccggaaattattactccaaacccccgatcaaaaggggaacaaaataaaaataagaaaaaacgagaagcaacaacaaagataatcgcagcaagatctcacacttgggcttcctggtgttcctcctgggcgccgccgcgccgccatcgccggatccaccggagctcgatccggcttcctggccgctgctcatccccaaaccaaccgcttccacccccaaaaaacaaaacccgccaccgacgccaagaaccgcccttttcccttccccggacaccaaaatgcgcgcttttctttctttatcttctcccctctctcctcagatttggagatgcgggtgtataaagcggaggggaaagctacgaacttgccgtcctgctgttgttgcgaagattacaagggaagggtgggtttgactaggagaagaggtggtggtgttgtggtggtcgtggtggcctccgcgtttgagcttcttctcccaactccaagccggcggagacgaccgaagaggaaggtggaacgtggaatttgcgcaggaaactgtccgtcctttgctgcgagtaattaattatttttcttcttgagatgagatgagatgagattttttcctttagaagtttctaaattctaatcgcattcttttcagccctaaaattggattgggcggttgtgttaggtagagtagttgcattgttttggattttttatagggagtacttatttcttttgaaaaccttcaaataattgaggtaattgtttatttgactctattttaaattttaactttcaatctgattttttttttcttcttttccaatcgaagatgaaggttgacccatggccgcatcccacacgcgtgaattcttagatttttatttcaccgcatataaagtctaaaagtttcctaactaaaagactagcaaaacctttttttttcctaattgaatcctctgtgaattagtatttcatgaaataattttgggtaaatagtaactatcactttctctgtaaaagcccttttttacttatattatgtttttctagaataatagtttatattagccatttattttaatgtactccatctgtttcaccatgtaagtcattcgagcattttccatgttcatattgatattaatgaatctgtctggaaaatgctagaatgacttacattgtgaaacggaggaagtagtgtatgtaacatgtaccgacatgattaacaaaagcaagtgcggtgaaacctgaaatgaagtggagttgtcaacatcgacttagaacacgtttagacaaatatgatggatctaaattacttttctaatgtagtacgtttcaattggtggaccggtggcaagaaagaaagaaaaattgagaagataaaatagtgagagagagctggcataagaagaatgcacatttaggtgggttaaagtgacgccaaacatgaatttagtagatccggaggccctcaatgaccaagtattttacagattataaattgacaactacatggcttatacttttcaatggactttcttataatttttttcagttatagacttgagaatatctttattcttaaaaagttgtttgcaaacatactacataatatttaacacataaatttgtagagttagactgtgttcttgttcttaccccaggtttcccaattatctcccttattttccgcgcgcacgcttttcaaactgctaaacgatgcatttttttgaaaaaaagtttctatatgaaagttgcttaaaaaaatcatattaatccatttttgaaaaaaatagctaatacttaattaatcatgtgttaatggaccgttccgtttttcgtgcgcgttccagttaggaacccgctccagcgaacacagccttagtgggtataccagtgcctaacctgacattgatattgtgtctcgggaatttgcatagacataaatagacatattatacttagttaatttattatctctatacattatatgttcgatcttctcttttttatgttttaagttacttaaaaaatacccgtgcgttgtaatgggtaaagtctattttaatcgtattattgttatatatttttagaaaattatgagctacagttaggagtccgatcgtcttaagttagcatgcgagattcttatatgattccttctgtattaccaaaagtgaacgatcttaaaaacgactcaaatatagatatgtattttcaaaaatacaaaaatttaaaaaccgactcatacacggatgacataccaaaataccgatgaaaacatcttcaattaataatagagaacgatattgaaggaaaatgatattgattccattccaaagaaagtaaggacaacccgcacaatcagcccaaaagtccatggatctgatattgtggactggacataccaaaggcccatattgtcatgttcggtatatcttggccccgttttttttcggcccaactcttctaatccatgaagcccactaaaggatggcccaaatttatttcctccctcgtcacctcgtgtcgtactaaacttcttccaaagatcaatcaatttcgagtataaagctttggtcaaatgaaacagagcaaaatttctccaagttcatactgcttcaaacgagcgagcgagagagagagagagagagagagcctaacaacataaataggagtaaatctttccatcatcttccaatttcccaaattatttgatcacttgaaatttgaatgacgtggagtactaaataattccaaaatttaccagctcaaaaactcaaactttatacaaaaagatttacaaaatctcccccatataataatttaatactacggcacaaagcgccactgatccgaacagaacaggtggtccgatcgccacccgcctcgtcgtcttcctcgcgaactctccacccccaccaccatggcgatggcgatggcgatgcgacgcgcggcggcgctcggcgcgcgccacatcctcgccgcctcgtccacctcctcctccggcgtcctcctccgccgccacgtactctccccctctgccccccccccccttcggatgtgggtttagggcgcttgctgtgaattgggaggtttgtgcagatgagcgtggacgcgggggcggcgatggagaaggtacgggcggcggggctgctccggacgcaggggctcatcggcggcaaatgggtggacgcctacgacggcaagaccatcgaggtattttttgccctagttacccgtccccatcgcgcgtctcaggcaggcatagctccggttgctcttgcatcgctttctctgctctggtgtggcgacttgtcaaaaaaatatatattagagaagtcactaacttgggaccgaaactcactgttacgcttgttcgtttcgatgcctgtggattgatgcgtcgtgcatagaattaatttcagtcgatttatggattagtacagaacatgcagattggaattgtgggggtgaaactctgttggactgtagattaattggtgaatttaatgtataggttgtgaacatgcaatttgctcttggaaatccctgtgagcagttcgttgagctaatttattttctgcaagatgctttgtacctggtggttttgtttcacattgctaggtgatttcgagaggggcacttataacactggggtgtctaggtgttgtaatgggaaaatctttgtattgaatgaaagatcacactgtctagtgctgttcgttttggaaatctttgtgagggggttactgagtctagatcgctggagaatgccatacacttacttgcaaacataaactagctctatacctttatatttttgttagagcatatttgccatcgctgttacagagttaatagtcatgaatgaggaatgtagcgttgcaatttaagctcatattgtggcttttgatttttctgcttaggttaattttgtcaattggactggacaataagaacacgttgctattggaaagaactttatccagtgtttatatctctagtttatgacagtgttagttgttgatgattaaaacaccattcttttcctctcttaggttcaaaatccagcaactggagagactcttgccaatgtgtcctgtatgggcagcaaagaaacatctgatgcaatagcttcagctcacagtacattctattgtacgtcagaagtataaactacattcaatttttatgcttcagagttgctttagtaggcctgatctttttaatgttatttgattaaatttcttcgagaattcaatacatatactggatattttgaatcgaatgaaatttagtttatctcagttctgtttattcttcttggcaataaagagcactagttttcacatgtgaccgatatttttattcaccacaaatatctagttatatctcaaaaatgcttctagtttgcttagatatcatatagctcaacaataacccttactaatgtcaagtttggtacttagagcaattcataagtaagtcataggatcaataactactgcaatgtagccttacaaggtgaatatctatcaaattcttcttttgttgcaagcctttcgaaatgtagcactggaaaattatgtaaaagatttagaagacagtctgtactcaatggaataacctttactctatccaaatgcaaaggtggaactcaaactattagacaaaaaaagagtacactattagcaaagtgaagttagaatttcaaagaatcatctctccttttatatttgtttattcttatctgtatcaaacttgtcatgtttattctttgccttgtacaacattttattccacattcctatacaataattagaggtctgtttggatacaattttgctctctatataactatttgcaatgttcagaggttgtgggggagagatgttcccttgtttgtgatcttggatgttaagccggtctccccacccagcgctttggtgccttttgtaatagcactgcagtttctgtttctttctttttactgttttcagactctgtattttggctttctcccaaaagctgggtaatgaaaattgcattccatctaaaataactatttgcagtaatttggataaattgatttgcttttgtttgttgatcatattcactacttatactccttttgtttgaatattaatccttttctttttttagcttggagcaaactcactgcaaatgagaggagcaaggctctaagaaaatggtaatttttatgagcacatattttaaagatttagtgataacaacgatttttatgtagtattacttagatgctttttctgacttatcatattgcacgaaggcatgatttaattatctcacacaaggaagaacttgcacttctcatgacactggagcaagggaaacctatgaaagaggctcttgttgaggtactttctaaaatactgcgctgatattcgttagttggaatatgtgattctaaagccttactggagactcattggttgctataaatattcaggtcacatatggtgcaagttttattgaatactttgctgaagaagcaaagcgtatatatggtgatattattcccccaactctatctgatcgtagattattggttttgaagcaggtaatatgctaaaacattgtaactttattaattatgctcaaaataactttaaccccaatcacttaaccggcctgtttttattgcatattcaccagtttgtcttgagccattgtcaatttctatctgtaacatatatagtagtagagtacttgtacgatctactttactatctttgctgagcttatacatttttatgaaagaggaagagtgatataatcagaaatgagtattggttactatctgattttgcataaggtttgaacactccattactgaagtgtagcacgaactaataaatagttttcttgacctgctgtagcttatctttatctttactatttaatccctaccatgtgaaaatttacatataaactacatattatatatcttagtgtttcttttgttacagcctgttggagtagttggagctgttacaccatggaattttcctttagcgatgataaccagaaaggtctcgagcaatgcactacacttctgttcttctaaactgttcaaaagggagaaatagctaaggtagtacatgttattctcttatatgtggttttgtacttttgtgcaggttggaccagcattggcttgtggctgcactgtcgttgtcaagccatcagagttcacacctttgacagcacttgctgcagcagatcttgctcttcaagctggaataccagctgtaattctctcaagttatctgcaactccacttatgttcaagtatttactattactagcgtagttcacatgcaatgcaaggatataaaaaaaatgtgtattgtagtgataaatttcacagtacaaatataatcgttctcaaatctgaaaaaaacatgttattcacatcagaacaatcacccagtggatgatatacacatgcgaagaggataaaatactactacaaacaacacagatgtctatgtagatccatcaggattggtgtgagaagggatggggggttttgagcacattatcaccagttcaccaccaacccctttcaagtagtagagaaatctaaattcctctctgttattcgcaaatgaagaagttgtttttccattatctgttcattcatccagtggtttttttcttcttctcatgattccattcatggtcgctatcttgaacatattcttttatccagggcgcaataaatgttgtgatgggtaatgctcctgagataggtgatgctctactccagagtacacaggttctatttcctcccattcttcatcatatccgcaatattagattcttccgagttaataggataagtaagaacaatttttttttacaagataatatgcttttaataggtcagaaagattacattcacagggtcaacagctgttggcaaaaaactgatggctggatcagcaaatactgtgaagaaggtataaccgagaagttctgatgtttggacaataaaatatattatgaatgctgattctcctttagaatacacttgattgccacatgtctgtatgagtgtgcaaggaatctgggaagaaggtttcaaaaaactaatgctaactggacagttttttctttcaaccttgaaacatgtggtggggggtgggggtggctatggtatattaattttttttttaaatccacaaaggttatgtacaatgaagaaattacatatgaatggaaactggacagtactctcggtttttgcaaactcacccctaacactttttatttctttcggcctagtcactaaaaaccccataaagcatgtattcccccacaatgtctatatcactaattagatgtgctgaaagcatcaaatcttggaaaagcagccccaaatttgccatttggcagaagctggtggaaatgcctgcattttggaaccccctgatggtgtgtttttgggctaaacttgtcaaagcatgctaatgcacttagcctgcaaggttcctaaatggtgtgttgttcttagatgtgttgatatagagttctaaattttgagcagtattttggctagtaatattatatcatgtcaataatagctttgacatttctgcttttgacctttttggtggcatattggtcgcagttgcaccatattgtcagtgagtaaggtcatttcactttatgtaaattatatgtttttagtgaggcttttcaaaaaaaaacatttctggtgttcatgctgataagttattttacaggtttctttggagcttggtggcaatgcaccttgcattgtttttgatgatgcagacattgatgttgccattaaaggcagtgtaagcaaaaaaaaaaaagacttatctaccatttcaacatttttttttgtggtgtactttgtttctcattgatatactgaccaacatacatcatcattaattgcattttatattctattatgatgcatgtttatcaacactacttctgttcagcttgctgctaagttccgtaacagcggacagacatgtgtatgtgcaaacaggatattggtgcaagaaggtagatttttcatctatgacatgtttatgttgttagggcctattttgctctgttacaatagtgtttgtctcatctgtaggtatttatgaaaaatttgcaagtgcgtttatcaaggctgttcagagtttgaaggttggtaatgggcttgaagagagtacatcacaggtacataactgtgtctccatcgccattaaaattatagaactaataacttttggcaatatgattcttatattcattgcctagacaaattttatggaatgcttatttattagcgttgtaagtatacctaatgttacagcacttaaaattaaaaccgttcaccttctggatgaattcatatggaccaaatttgcctctctgctctgtgcattttgttatacctatatgacatacattttagaatttatctattcccaacttaggatttccatttcctttaatatgcagggccctctgatcaatgaagctgctgttcagaaggtataaattctgcagacttccagtaatttcccatattgttaatgttaagtaatagttcctcaaatgttccatctgcaatctgtttcctccaggtagagaagttcataaatgacgccacttcaaaggtaatctgaaatcatcacaaggatgttcattcccccctttgaaattagggtagggttaaaaaatgtaaaactgcactgattgctgcccctggccccatctggtttgttggtctataggctgtttgctggatttctcttggaaaacattaacttggcctgtaagggtatataaatcagctttggctagtacttatgttgtttgcctgcttcagttaaagactgggaccttgtttgttttcttttgtctgcttatctttgcaactgcacgtaagatacccccatcatccttttgcagggagcaaacatcatgcttggtggtaaaaggcacagccttgggatgtcattctatgagccaactgtagtagggaacgtcagcaatgatatgcttcttttcaggtagggttcaaaaattgtgatttgaccttattttagtgcatatgctttaccttcatgcgaagaaatgttcaatcattgagaaattctttgacatccttgttctagtttctaacaatcacatttggcttcagggaagaagtctttggtccagttgcaccacttgtaccattcaaaactgaggaagatgcaatccgtatggccaatgataccaacgcaggttcgttactagagtacagtatattcttaactatttaagactgtttccttaaaatttgctcttcagtgatatgcctagtcctttaaagaaaaaaagaagaagaagaaactgcattgtagcaagtcagggtatttctgtagtgagagacaaggcaactaacatggatgtagcaatatagaattttaaccatgtaggcctatctaccttaagaattcctgacagttatttatccatattagttcagtcatgtccttgttttgctttaaggttgaaatatgatgagaaacgatgtccatactgctaacctgtagaaatgcatcccctattgctagctgtacaaacatgacatgtttcccttgttccttccaatccctcaagaattatcttcttcaatgattaattgcaggcttagctgcatatatcttcacaaagagcatacctcgttcatggcgcgtttcggaagctcttgaatatggactagtcggtgtgaacgaggggatcatctcaacagaggtaagaagcaagcaccgtcccagataacaaaagctaagcaactccattctccttatggtccactttataaatgctgttctaacttgttttttcttcaggttgcgccgtttggcggcgtcaagcaatctggccttgggagagaaggatcaaaatacggcatggacgagtacctggaggttagcattgccattagacatgcaaattgcaaacacctctctggttttacgcttatcctgttcttgatcacattgctcggtttgcaattgcagctcaagtacatttgcatgggaaacctgaactgatccacttgagagtaccgtgcgtcttaaaaccgaagtacctggctggtgatgaatcgaagccgggggcaagagtagctgcaagaactgaagagcactgaggctacttgcacctgcaggacaggttagaaacttagaataataataagaagaaataataaaaataaagtggagtaagctaagccagggagccggaataaaaagttccccaatgagttgtacatgatgtgaaccgtaaagcacggcttcatctccgagctttgtttggtactagtactacctgagaaatcatcacgctactcatatcagtagtgtccatgtccaaagacaacaactttaattctactactaggaaataaaaaaaatggaaagcctctagtcaagcaacaaaaacaaagcaaaagtatccaatgggctcgaccatgagctgcatgaaaatcaggccttgcccctttgggaccattttgcatgatctcttgatgtattgaattgagttgcggttcaagaacttttctgaactcatatgcatgtggtctgattgaatcttaccataattgcgggattcgctacacgcctccgttttattgtatcgcatttagacatcgattcgttggtgcaaaatgtgggctttctagagaatttggaggatacccgcaatgttctgccaaccttttcacgtccttccttttgaggcgaggccccaaggtttaagatttcatttcagtttgtgaaatttcagacttatcagtgcacccggtagccagctcagttgattctcgggataagtgtattatgacctcgtgcaatttgttgagttcaataaatctcctgttatctgagaaaaaaaggttaagctgattctggtaaaaggaattgtgataacatttaaactccctccgttttactacttttgtctcaaatttagggttaaacatggatattgagaaaattggtggagttaaatgtgggatggttgtgattagatgagaaaaaaaatgtaggtgaagttatattttgggataaattttgaaggctagaggttgttatatatttttgtattaacggaggggtttttgatttgtttcttactcaaactaatttgatgctatagatatatctatcagctttcttttataaacttgattaaactcaaagccacagtgatttataatatgaaacatggttttatattttaggacgagtgattgttgaatctcccaccaaatatggcgtggtaccaaattaccaataccattttgcatgaactccatcaaaaccagttttacttatatatactcctatacatcatgtcgtggtagtatttggaggaggaaaaagcacatgaaataaaaatgtagatccggccggtcaccgggatatcctctcgagtctcaagttctcaacactcgtaatagcaggtacaatagcaggctataagctagctataaacatattttaaaaagataaaggaagagagagaatagtagcgggctacagatatataagccagctgtaacacggacttcaaaacgtaatgtgtgtatgacagatgggaccatgtactaattgtatagtaaacaactattgtagaattggctattacattggctatatatgatttggagctattagtgggctatactattaaacttgctctaatatagtatcatcattcataatcctctgtcgctctttggcacctaccgaggcaacaagaacagacaagatattaaccttactactctacactgcactgcactgctaccaccactacagtcagcagcagctaagctagcaaagcgtaaacgaagcttcctcttgcatcaatggcgcctttcttcttcttcttcttcttctctctctttcctctctttcacccaaaggctgcctgtctcttgccagtgggacccacctgccagagaagatcagaccggaatccgaggccaggatgatttgcctcgaaaattgtgctctcagtgttggacgcttttggagttctctcccgtccgtagcatagatcgagcatatgggttcggttcaacaagaagcttccttgaaatctctgcatctctctctactttatctggtctctctgcatttcccatgcaccaataaagagtgcttctactgagggcctgtttaggtggtaaaaaattttgccctttcatatcatatcacatatacagacatacatttaaagtattaaacgtagtctaataacaaaacaaattacagattccgccagaaaactgcgagacgaatttattaagcctaattaattcgtcattagcaagtgtttactatagcatcacattgtcaaatcataacgcaattaggcttaaaagattcgtctcgtaatttcttggcgaactatgtaattgatttttttctacatttaatactctatgcatgtgtcaaacatttgatgtgacagtgtgaaaaattttgtttgggaactaaggcctggtttagttcctcaaaaaaaatttcccaaaaaacaatacatcgaatctttagacacatgcatggagcattaaataagatttttttataaaaaaactaatcttcctcttatacccctaaaaaaataggctagcattatcttaatgcattcacaatatacaaagcagcaagaatatcagagccgcaaacttagatatatacaagtgtatattgtagtgacaagtggcaactactacgcaagccaacatgacgttatatggtactattgatagtatatacgatagcattgcaaagaacaattaaccctccccagagaaaaaaaaaactaaaaggggttggaaaagatggaaagatactcaatgtgcgtctgcctcattcaaggtatggaagggtatggtgccgggcatcgccaatgcttcaatataatgcttgttctgtggtgttcttcgagtctattttggtccatcgctcacctatatctgcatgtcgacttctatcgttcttcctttttctatgtataggtgtcaacttcctccattcctccttatctgtgctatctttggccggatattgtttaattgatgttgcatatagccaatctgatcacatttctgatatgctagaagatttgttccttaattcgtgagggataggctagatgatccacagattaaatggccttctttacaaaagaaaaatctgaaataacaatgcatataaacccaatccctatggtacacatataaataccttgaagcattttcagagagcttccaacaacggtatatacaatgcaaggacaaaatgccaactaaataacaagtcttttttcccctttttatgggccttttaatttgtcactacacaccttatgtacatgccactgtgtgcctcgccttgttattctgttcgcgatgttgaattgttgatgtagaccgtcggatctgctaaagcatgcgatcctcaagaatatttgatcaaatgggttgatatgagacattagagccacattgatcaatctccatgtaacaaatgtcatgtatatatgtactttaatttccgtaaaaggccacaatcaatttatctctaaatttaggatatagtataattttaactctcaaacccactctacatacctaaacattttgattccttgtatttgggcagaccattctcgcttgaggacaccgtatattgaatttgtggatctttgatgatcttgcgatcacaactttgttcaaaaccgccaaaatcatttgtgccatgtgccctaatttaactatgtgaattttgtaccctgagaatctaggcgcatatatatatatatatatatatatatatgcttcttaagattaatttaaaactaaaagtaaattttatgaaaccccacctattatggtctaagtcgcaaaaaacacagggattatggtagatgatacattaatctagatattatgattataatgtttcataaaaccacgccattatcgatttgacatattcatgtaccaaaatttaaaaagctgtacttacatcgacgtaacacttatacgatggataaagaactcatgaatttaagatatatgattgtatagaaataaaaaaatatgcacgtagcatatatcaaagtcaatgatcgttttgtagaacattatagccataatacctggggttgtcacgtgccaaaacccttatggttttgttaactccaatcataataactgccgtaggtgaaatttaggtggtgtttagatccagggacttaaatttagtctctgtatttagacactaatttggagtattaaatatagactacttacaaaactaattatataaatgaaaactaatttgcgagatatatattttaagcctaattaatccataattagagaatgtttactgtagcatcatataggctaatcatggattaattaggctcaatagatttgtctcacgaattagtccaaaattatggatgggttttattaatagtctacgtttaatatttataattagtgtctaaacatccgatgtgatagagacttaaaagttttagtcccatctaaacagggtcttactactccctctgtcccataatataagacgatctgtctagattaattgtactaggatgtgtcatattcacctaaaatcccttatattatgggacggataatcctaagctgcagggacagatctagctagcaagttttcaaagttcccatttcaattatgctgttgtcatgaaccgaattcgaaatacgaatcgttttgcgtgtagtacgaatacactcttgctttgattttcctttttcctcccttgtctttcttcttttcctctttacatggctgtagaatcatcatcatttcgattaggcccacacggccacacatgagggggcttgattgcaaaattacattttgataatgcttaatttcatgcatgcatgcatgcattatgcatataagctcgttcttaatttggcttaagctaagccagctagataggagtactatagtgtgtacttatcttgctagaagtaatatatattttttccttgattccatatgtgtagtatataattaatcacacacatataattatacagaattaataaggcagattcgttttgcttttgctttgcaggactactttgatgattcatatatattttctgcaggttgacgagatatatggagggagtatatatgtactatagtgaaggctttgtactttatatcagatatatatggagggagtatgtactccagctcccattcagaaatgtacatattgttttatctgggaatattaatctactgtaaaacttattatattatattatataataattaacttggaccactgatatatatttacctatattttacatatggtcgtattaatcgatcgatcgcagctcgtattgatatcaaaattccatatatgggaggatatatatgtagcacaaattttctgtattatatttattagtaatacagcttattaattgagagatggatgccatatgtgtgtgctcattaattaatatagttatcttggaaaatgtatatatccatcttgtggcatattatatatatattgcagattaattgatgcggcaacgttttacagagctagaacaaatattgatcaatcatcaatgtatatacacacatctagctagtgaactatgcataaatggttaatttatttgatgaacacatacatatatgtgcatatatatattcgatcatatgatcgcatgaatgaaccttgagccgaagctatagtctatagacgactaggtgcatttagtttttcatatttcagaaataaatctcaacatatttccataatcagtaaattaaatacacgtatcaacctggaatttaagttccattaacattgtgttttttgatcgaccgacatacgcgcatgcagcctcagatatatcaatgaaagcttgtttctttagcatgcaagaatgccaaatataagttacacatttacacccatgatcttgataattaacacaacacacaattacacagaacatattacatgcatcctcaaaatagataatcttaattagcatttgggcatcatcatcaagcatatatatgatcgatgcaccacaataccacaagatcatcctgattaatgccgcattaataataatttaccccctgttgctaccaattatatatccattaatccatgcatgaactcgagctgtaaaacttatttagccacagttcgatcgatcgagcacgagccaatttaattaatttcctctgctgtgattaactggtttaattagttaattaactcattaattaattaactaattgtgattacccgtaggataggttcctcgtctgagctccggccatcaccgacgggctccccagctgcggcggccgccgcggcgacggcctctccagcttcgacgccgccgccgcgacgtcgtagccgccgcccttgctccccgtcgagtcgccggacatgatcggcttcgtctcgtagacgtcggcggcgagggagtccatgacgtcgatgccgccgtccatcatcggcggcggcgccatctgcagctgatgatggccgccgccgccgcacttcccggccgggtcgtcgtcgtcgtcgtcgtcgtcgacgccccacatcatcgggctcttcccggcgccgccgtaatgcctcgtcttcgccgccgtcttccccagcgagccgccgccgtcgccgcaggcgaagaagctctccatcgtcgacgccggcggctgctgctgctgcaggtcgaggtggccgccgccggcgccgccgtacatgtggaggtcttgcagggaagggaagcccatggagcacacgtcgagcaccgccgcctggtggttgcctagggatttgtaccccgccgggccgcacgccaccgccgccgcgacatcgccggcggcgagcgtctgataggctttctccaggatggactgcatgtacttcccctgcgcttcgatcctcatctgcagatgcttctgcacctgcatgtcaccaattagaattcatgcccaattttaatttgttggacaattcaaattgtccatatatatgcatgatgatgagctttgctaattagggcataattattagcctaattaactaatcttgtagttatggtaataattaagtagtataagtaaaggttcatgagaatgttgaggtatgtaatttaagttgttgatgtatgcatgatgagaagctaagctggctgtatgtatgcatggcagcatgggaatgaagggcagaaaagtggataggtaaacttccctggtgctttatttgaaaggagaaacttgatgaaacttcatgtgaatttgttggtgcaatttaatttgaatgcatatgcatgtggatgcaacgcttttattttgttaattacctctagttgctcatgtagccttctttgcacctccatctgcattctgatggcatcgttcacgttgcggctgagagagagaatttcacacacaagcaaacacaaaaatggagttaggaaagaacaaaaaaaaagagtaactgaacaaggactaagaaagaaattaaaatcttaaaccggattaattctacagtactagtgtactgttactagtgtactagtgtaggtgatctgtgaaaagaacttactcatggttcatgcttctgcccattatgcctgaagaagatgctgcgtttctttgcatctccattgccgcggctgtggaaaatttcaagaacaaatcagtcgcctcagactatcagttgcactggtggtggaaattaagttataacttcaaattcaaaactgaaatcaatcacactgcatgctagaagatcttgattaccttccttaactgagtgctcgctgaactccttgtgcggttgcttccctaacctgaatttctgttcatgatatattcaggaaaccaaaaacagatttagttaatcatccaacataagaatatagaatcatatagatagaaagagatcgaggaacaagctaagctaggagaaaaccctagctagctaaggtgtggttagctagctaggttacctggagatggctcttgaggtggtagagggtgaggcccttcactcccatcaccctcatgatcgtcttgggcgtcgcctctgcgacgacaagacgatcatcaattcatcgtaagaaagaagagattaattcttgtttcgatttttttggagagaattgattgagagattgatgatgcgtactgtcggggccgccgagctgggtgacggcgtcgacgaagcgctcgtggagctccaccgtccaccggagccgcggcttggggtcggtggtgaggaccaggccggagtcgccctgcacgcacatcgccgccgccgccctgccgccgccgccgtcacccgagctcaccgcggcgccgccgccgccgcccttcttcgagccagggaacattcttctatgatctcctctcttcttcttctctctctagatctctctcgaattaattctctctctctataataataataactctctctacctcgtcgatccttgatcctgcccgattggagacgacagattcaagaacaaggaatagggttcgctcgctcttcctctctctctctctctatctatggcttgatcacacttgtagctctagcttgtgctcatatgctctttagtctctctctctctctagatgggtttctctctcactctctcctcttttgcttggggtgatggctttgctgcttcttcctttttttttgtctgtgtgtgacacaaactttctctttctttgtttctctctctagctagctagctagctagctaggagtcttctgctacaaagcccaagggtgatattctctatcctggccgggaaaaagccaccaaggccgaccccaactccatgccttcaacccctcctttaatttgccaaaagatgagaggggctctcttttggttttaattgagtagtgtgtgctcatataatatcctttcgacaacatggttagtatatatagggctacatatatgtattactagctaattatatagcatataaatttttataaattttataacgttataaaataaattagatggataattagaatcgctatgtaaaatactggttgttgcaaaaaaaaaatgtaaaaaaattatgagaaggtacggtttcgaaacttcaatagttatcatgatagtaggtgcaaatagagtaactaacacatatctagatataatttactcatagggcttgtttggctgccgaggctgccgcagccggcacgaacagcgccacactcactgtgcgcagtcgcaaccgtcgcagtcggcctgctgaacaggcccatagtacgtgaagcagtaccggacattgcaccgttttttggatcattacatagtctttccaattctttttacacataaaataattttgttgaaatgccttaatccaaagaagttcttaggtctggcgtaaaggattcctataaacagatattaaaattggatcaactgttatatatgcttctgtcagtatatgtactataatgtaactagtcattaaggatgggacacaagtaattaagtacatatatatgtgacatgtgtttggaacacatttatgtggatcttctccccctgatctttgcaatcttccacccatctctttcagaatcagaggatgtaacagttagtgcatgaaagcatatatagttaattagcatcagttttggattaaactgtgccttttgctcggcactaaacagatcatgcatgattttgtctttgcgtgcccccacaccattggatctatactctctctgctttttatatttccctctttggcactagaaaacaaaccaagtaagctagtacgtactgacctttattttgtacttatagtgtgtgcataccaggtccctttttgaccagggagcatcggtgtttttacattaaatttgttgtttttttattaattaatttgtcgatgttgttgtcgagatttgtcgttctagacatacttttgatcattatttgaccaaaaactattaagagcacaatgagatgtgaaagtacgtgttatttcaacacacgacgacttaactgtcgttctacagcgtcctaaaatgacatttaaagcagaaaatctacatcaactaccaaggaatgtgggtagtgtttattactcactccagtttcattttaattgacgttttgaacaatgacacggtctacaaaatatatctttgacattatttttattataatacatataataaatatatgtatgtttacttttattatagtgctttgaaagaaaaatctatatatgttgttctagtccctttaaactaaatatttttaaagttattgatggtcaaaattataaaagtttgacctcaactttgtctaaaatcgtcaatttatatggaaccggagggagtacttaattaacctttgattatttgagctgataaaccttataaaaataaacaaaacaaccaaaagaaatttatatgtaaaactttaatatttatattgttagcggaaaactataaaatagaatatgatgaaaaaactctatgaaaaaaactccaaattttaattttggttgacaagccaataattaattagacggcgagaggcttataactacctacccctccgtctaaaaaaaagaccaaccctacctaccccttcgtagctaggaattcgttttttctggaatggagtaatgaaaaaagtccatacaaatttaattttttttaaaaaattgccctttgatttctcaccaaatcaattacatttttatggaaatactagcatcatgtccgtgctttgcaatatatcccaagttcccaactgaatatactataagtataatacaaaattaaatacataattaatattcttcacatgtaaaactatgtaaatatgtgttttttattaaaaaaatctttcaaataacatagacatgcatacatatttacatacacaaaattaagatctacaatggaaatgggggcaactacaaaccatcatcacccctattttctcgtttaaagaaaaaaaacaatatatcacatatcgatcatcagacattccgcataagttacatatacacttctgatctatgtaaccttcactacattggggtcaatatatatatagcttttttttagaaaatgggataaacccagcctctacacaatatataaatagccagtgacttgccttcagaaaaaaaaaaaggagctagacatgcttacgtatatatactcccaaaaggaccaggtagctagtacaacatatattttaactatctaacattcagacatcgaccatgcagcaagcctgcaggaacttatcatgtgtaaatcattgcaatgtaaaacatattttgtaggaactggaaaaaaggatgcaaatgcgttgagcctagagctcgacaagtttggacaagaagagacaccaatcaatgcaacatacatatgttcacccaaaagaaatcaaatcaaagtccccatgtcttccaatattgtagctagccactcatcatgccattggtgcccatgtggggcacttagaattcatgcaactttctctttctcttctttccattgctgactgatcttgaatgtggtgtcagatgaccagacaattgatatgttctgcattagaatgagaattttatcttatatatatgttgcacttgagcccttgatcatgcaacaaattaattaagcagaacaagttagggaagctggtgcatggtttcatatatataatgaaagtccctaattgttcacctcagaaatctcgtttatatttgtagaaaaatattaattaggtaaacatatatatatacatatatatatatatatatatatatatatatatatatatatatatatatatatatatatatatatatatatatatatatatatatatatatataaaatctattgcagaccaactgagtgtaaaatacaagagaagaaataaactgatagggaagggtgtgagaagacattttgcacttgttaacaaatgaaccctaatgccgcctcttgctcgttcgcgatataatatggtatttttcgtaaatatcaatatgttactgcagggtaaatatcaaaattttgatggtatatcaacctatgttttctcttatcttgctacatgacacatgacaacttgtgtgtacataatatatatatatatatatatatattaaaagagaaaactacaaaagatcagcctaatagatattgatgctacaagggaatcaaaggagcacatgttcttcctcaatctccctccacatgtgcttgcatgcttacgtcaccactaaagcattcgccaacgacacctcaaactccatgcatgaaaataattatgaaagagaaagtgaagttgtgagaggtcaaaaattagggtttagcttcaagcctccaagaggggtcccatttaggaagggaaagtagagaggatgagtaagaacattgtaaagcgcccgtgcgctgcctcactgccattttctttatctacaagggaatatatgcttccttctttgacaattaagcaaagattcttctcaaacattcctcaaatgtggttttattttaacagtattgtaagaactagaccttgtgcctttgcttaagcaataagaaatcgatcgacaagagaacacgggactggagcatgcgaagaaatacatacgcagcgagtgttgtcgatgctactggttattatcaagagagaagtcttagtccataaaaattaaatttatacttgtctctctattgaatttaaaatttaaaattaaatttatatatccctattgaattcaaattaagtaagcaaattataccactcgactactatgctaagctaatgaagataaattaaatcatatcaagttcaatttaagacacactaagggtacaaatatatagtggttcagagaggaaagggatgtcccatcctccctaatatctcaagcactccatattggtagtaccacagcctttcttatatttgggaaaaatatcactacaagaaaccaggattttcttggcggccaacatattttatttgcggtcaaaaaataacggccaagtttaattaccctttgtcttgatgattaaaactagccacctttgttccctaacatatgaaacaaaactttatttgagtctcatcataccctcatttcacacatgtttatatatataggttctgaaattcctgttgatatgtatatatttcatactacctctgtttttttaatagatgacgccgttgactttttctcacatgtttgaccattcgtcttatttaaaaaaattacgtaattataatttattttgttatgagtttttttatcactcatagtactttaagtgtgatttatatcttatacatttgcataaaatttttgaataagacgaatggtcaaacatatgagaaaaagtcaacggcgtcatctattaaaaaacggagggagtatgtttctaggcctaattaagcgtgtgtgtattagtattttttgctcacttgtttcaaacaatgccaatctcaggtgcaataatcggacggaatacatgcaagttcttaattattgtgtgcgcgaagttatatgaggtaattaaaataatcattggttgaatatttgaattgatggatatccatgcacactgtaaaaatctgttctatcgttaattaattaagaagtaaaattaacaaccatagacatcaacatcaataatcgtttaaaatgcatgtaactttctcatgatcactcggtctctgcattcttttctgcacggaagtggaagaataaagacgatatattctcaagaacaacgctatataatagcagccttatttgagcatatactcaatttttaatcagtgatgtcttgttttgttctcgcaaaagataatggccaacagtccttatcctgtagccaaaataaccttgttttgtctttttcatggatgcagagagaaaagacagcactaccgtatcgaagtcaactaatctattttaagacaggcatcaaaatctaatgacgctatttctgataaatttcagagcctttatactgatacatatgctgcttaagcggctgtggttccattagacttctctgagaatctcatcaggtacacaaactaatagctaacagaagttttcagatagtttcttctcaagaatcttagatcttaattagcaggtattaactgaaaaaaaacagaggaatgatagatgcatcgtctagctaacaaaattttataatgtatcagttaattaatggaactaaaatgcactataacatagtacacttttattttattaattaattattaaaatttctaggcgtcatttggacaacatatatataagcaaacaagatgtgcttataggccaagctaagatatatgtgtgtgcgtttataccggtgagtgcatgcacgtgtttatgaacgtctacatttatactttatactatgtttttagaaacatatcgagcaaacaaccatggtccgagagctgtgcttgtttgggatgtaggagaataatgttgtcaaaattatttttcatttactatcggaagttcatatatcagattcatttccaaatatatatatgacaaattaatagaaatgaacactcataagtagtgtatttggagagaacatacatattataattggtgtttaacatgacatgttgtgtgaccggagggtactataggttatgtaaaagtggtattaaccttcaactcattgattaatataagctaaaaagagtaaaataatcctatccacatccactacataattaagcagttagcttacatttcaagcagacatttgcagaccgatggcttagctagctatgacaactttgttattttcttattgatctgggaggttctcctttactagtattcatcatgtgcaaaacctaatactaaattttagtgatctgagaaacaacagattcctagctatagtaagtgcagttacgaagcaaaccaaatctagtatctaagaagcaaacaataactgatcatgtttaatcatcccatgatgatctagctaggcacagctaatcagttagaagtgtatacagcgtttctttatctctaaaaaaattgcagtttatttgtgaccttagcaaagcaaatgcaaattaatcactagagatattagcacatatatgaagaaaagtccatctttggcctcacatgattaaagccccatacaaaataaagtacatcttccaactttaagagtactttaatgtgtaatactttaagttctagtaatcatagtgtagcatattatctctccaggctaaacatttggcaaggttagcgtgtgaacaatcttggtttgattgtcaatggctcaatgcagtatactactatcgtggtgaaattaaagagacaatcgaagctttggtctaaaggaaatctatggaagtgtctaatgtatatcctccccttttttcttaccttccttttacttttgtgtgatctttgaacaggagatgtgattgccattagggtcccttttcggttatttttgtagtttgcacaaagcggagttcatatgatgagctatttttgttttggtttctacatgattaattaatgcaattaagattgtgttcatgttctttcatacttaatacttcatgcatataatttgatggatgaatgtattgtgaactatatatgtaataatttggctatagtacttctaacttgcgaactatgtaataatttggctatagtcgtttctgatgaaacaaattaaatgccaggattttttttcctttaacaaaacatataattaaccagtaatgtatcagaattaatataatggtagtcaactgtattactaatgcatggtggcccgcgcagattgcgcggctagcagcattatattttctctcatacaatagtataaatgttttctcattatattattcaaatatattaaaatgacaacataattttaaattttgcaataactttacaaaactactaatgtgtaatattcatattgtattttatatacgtgttagttattaattatttttaatatcaaattttagttatttgtaaattatatatttcctatatggactctagactcgtcttttaatatttcttttttttaatttcgaattttctgtaaattgtatttctatatagactctatgctcttcttccaatactatttatttttatttctgaatttttattatttctaattttatttctatgtggacactaaactcatctttcaatattctttaatttttaatttcgaatttcagttacttctaaattgtatttctgtattgactttaaactcttattcccatgtttttctaaatttcgaactttagttatttgtaaattgtatttttatacgaactctaaactctacttttaattttattatgttcattctaaattttagttagttttaaattcctatatggactctatactctacttgtaatattccttattttttaattccgaatttctattttttttcttaattgtatttctatatggactctatactctacttttaatattctttattttttaattccgaatttctttttttcttaattgtatttctatatggattctatactctacttcaaatattccttatttttaatttcgattttcagttattttctaattgtatttctatatcgactctatactctacttctaatattccttatttttaattccgaatttcagttatttcctaattgtatttctatatggcctatatactctacttttaatattccttatttttaattctgaatttcagttatttcctaattgtatttctatatggactctagtctcctattctaatattccttattttttaattctgaatttcaactatttctaaattgtatttctatatagactctagtctcctcttctaatattccttattttttaattccgaatttcagctattttaaattgtatttctattctatatggactctgtcttttctttttctccgattaatgtgagaatttctaggccatgagagcgaacgtggaggctcatttttctattcctttaattatataatagatagatttcaactatttctaaattgtatttctatatagactctagtctcctcttctaatattccttattttttaattccgaatttcagctattttaaattgtatttctattctatatggactctgtcttttctttttctccgattaatgtgagaatttctaggccatgagagcgaacgtggaggctcatttttctattcctttaattatataatagattagcaggacctccgagattaaaattagtcagttactaatttcaaggtgtaaatggccggtttgaactcagagcaagcttgtcggatctccggtcaagagggattaatcaaatcgttttctcccttcttgctgcactttttacctggctaattaagctcatcatcaaccggcctgtgactgagtgacgactgacgactgaataagcgactctgagctttcaagtgtccatccatgtcggcttgattttcactttaatttacaactctctcccaagtccaaaccaatggcctccatggttgaaaatatttccctgcgaaagtgacgatgcacttataattgttctttgactcccacacatccttgaaaaaaaaaacatactacctccaataacaaatatagcgtttttatgttgttcagtaaagattaaaattgagaagaaaagaattttgatgtcccttgttaaatgactcataagtttgtaatgggatggtgggatgaaggtaagatcagaaaaggattaaattatgaaataatctgaatgaacaaatttcagatgtttgtaatatttatatttgtggacagagagtgtatatgtaaattcatttcttgtaattagatagtactacatatatacatatgcaattttttcgtgtcatttttctctttattaggaaatgtggtttggctaagttcgataaataaatgtacagtgcttaataatatgttgtgcttactaaaaacacatgggcaatcagttagtcaagaaaaaaaaattcctaagaagtaattaataataactaagaggtccagagaactgggctccagcctgatagtaatccaaagttacacttacatgggcgtgaaggcagttacatgggctgcactataacaaatgtagtcatgatctattgggctgggccaagttatttcagatggcctaattacggcctagtaagtatatgcttcgcaatgtgatactactatttttctttcaattgcataaacgatgtgcacgtaaacagcacactttgataatgaaaagaaaataataaagtttcagtacagaggctaattcgtgctagtttcaaataagagtagtaaagctcgatggtcagttactgcgtgaatgcaaccaaaataagtgagagtggggtattcttaagatatatcagatcagttttccaaatatacttatagacgtaggatgtgtatgtgtgcatttaataggggtgactgtatgcatgttgtgagtatgtacgtttatatatttctcaaaaagaaactgtatgatgtgtcccttctatcgtttagaattaatcaacttttgttcgcattaccatcattttggattataagccacaacacttattagaaaataaaaaataatttatgaatgaaatttctatttactatgcattttgcactacaactatatttttattttctttttatcgctcaaacagattaaaaaaaatcacttatgacaaaaaaaaaagagccacccaatggcaaagtcaacaacatcgtcaagcctaagcgacaaatattttttacgacagagattttttaatgttgcgcgcagttgatataatagtgacgttagcggcacagcctgagaccaacggagagaaatcaaaatgtctatttttattgtgatatatctttttttttcttcttacaagtccagtcgcaattgactaagatagagctctgttcatgatgtgataatgggaaatggcccggcaccaaacgacggcgccactgcaggtacagtggctcaatcctgagcgtccatttttgcatctttcgagatcatatcattgaccccatcgagatcgtacggctgtgattgctccgtcgacatgcacattttgccggttaacgcctaacaataaggccatctttaattacttctctctagctacccgaataattaagcaatatacaaattctgaaccttaactacaagagtgtcatgtgattgtctctgaacttggaaaaaaagaaaactgaatatttggtggtgttgccgttgtttccggagacattatgcatgtgtggtgtgtattagattattttttccccaagtgatcagattaagaaattactacaacttgagctttaactaggtcaaactgtctaaacatcaagccccttaaaatgagttaaggaatttcatttcatgttgggaaaagcgtgttggaattgtggttgcatctcactctgtattcaaggtcctgagatcttgatgaaaaaaaaaagatggctatgcgtcgatatctaattggtacaaagattcgaagttataatttcaatatcataaaaaggacgtcgaacgagaacccagcaaggttccatgactatactaataatatttgattttgcaaacttaatttacatgaaaaataattacagaaacaacaagataaggcatgatcagagcttgtgaatataatggaggccgagtcggaatcacggtcacctccacatcgtatcattcacaacactatcatctatacctttctatctttccatcaatcgaaagtgaagaaaaagataattcgaaacaggaattaatggagcaggaaaacgacctctgacctccattattctttatgctgggaaagattcagcactcactatgctcagcttctcaactataaacaaatttgagagtgccccactaacagctatagctaagctagagagcttaatcaacaacatcaattggcctattgggcattctttaattaatttcaagagagggatatgcacactccccatgttattttttttttcaattaaaagaaacaatagcgcacatatgctatgtggacacactttttgtaaagtgtgcacacccccttatacacgctttctaacagaggagaaggcttgagataaatccatggaaaataaataaataaaactaactgattttgcttatgcttaatctatcataagagctaggatttataacttagtgattagagatggaacaataatcaacaacttgcttgttactatgatagtctataagcaatcaacgtactccctccttccctaaatgtttgacatcgttgacttttttaaacatgtttgaccgttcgtcttattcaaaaacttttgtaaaatgtgtaaaaatatatgtatacataaaagtatatttaacaataaatcaaatgataggaaaagaattaataattacttaaattttttgaataagatgaatgatcaaacatttttaaaaaagtcaacggtataaaacattttaggatggagggagtatgatttattttttctgttatcttcatttatttttctctatatatatgtttgacaaaagaaaatcacagggacaggtgtctctgttttggatttctttttattatttgatgcctctaatgaagttataaaatcaaattatatttaaattgtcaacgaaaggaaaacatttgacactcgagtgtttctccgtgattaccagtgtggtaaccaaggacaatttcatgaaatttaatctgtgcaagacagttcttggcacactagctactaattaattaagtacggcataaccaagaaagaacgagctacgagacttggtcgaagcaagtgagtttgttctacccacctaagtcgaacacacttaggcaagcacgatatgctttattttatttgtagaaatacactagtaaagtgatcttgctggattctaaacaattatccctccgtttcaaaatgtttgacactgttgactttttagcacatatttgaccgttcgtcttattcaaaaaattttgtgaaatatataaaactatatgtgtgcatgaaagtatatttaataatgaatcaaatgatatgaaaagaacaaataattacttaaattttttaaataagatgaatggtcaaacacgtactaaaaagtcaacagtttcaaatattttgaaatggagggagtatttatgtggagtatattacactgttagtgcttatgcataagcatgtctgtgtgcatatgtggtgtgattgtgacatacggtgttgcacccaccgagcatctgtttgaacctagaaatattgtctgttttcctgccgaactgaactatttaatgtgaaattcctaggaaatctactctctccacatcatattataagctatttttatttttttatatcaaactttttaaatgtttgaccaagtttacagaaaaaaaatataataaaacttagagcatcaaattagtttcattacatctatcattgaacatattttaatgatttttttattttgtgttgaaagtattgctatattttttttataaacttgatcaaatccaaagtagtttaataatttagaaaaaaaataaaaacaacttataatacgaatggaggtaatagcattttaaccttagcctaaactataccacgcgaaaaaaggcaaaaaaaaaagctcatttcttttatgtaagttgtgaaatattgtttgaaaagatttcaaaacctcttacaaaaaaggctaccttgtttgcagaaaaacaaaaacacttttgtttagcccaaaattaagcaaaaacaagaagaaagctcccaaataaattagcaaagacttggcttttttctattccccaatgacttcttcttcctcctcctctccacagtccacactgttcatctcctcctcccctccctcccaattcgattcccaaatcccaaaattgaccacccaaatccgcgccaatccatggattggatgcctcctccgaagcccacctcgccgcgctcccctcccctcctctgggactgggccgacgccgccgtgccgggctcctcctccggcgaggtatccgccgccgccgccgccgccgcggctcatccgggaaggcggcggaaggagaagcgaggcagggcggaggaaggaggaggtggtggtggggaggtgaggtgccaggtggaagggtgcggggtggagctcgtcggcgtcaaggactaccaccggaagcaccgcgtgtgcgaggcccactccaagttcccccgcgtcgtcgtcgccggccaggagcgccgcttctgccagcagtgcagccggtgagctcgccggagtcgcgcctcctcttcctcttcctctctctctatattgcaaaaaaaaaaaaatcaatggaagcacacagctccaagctcgtgcgtgccttccttctcctcgattactttctgcaaaaagattcccttctcttctttggttcttcgaattacaattacaatttacagtttaatcacacgattggttgctgattaatttgcgcgaagctcgtgcttttttacgtgggtggtgaatttttctggtgtccgtacggattttccatttccgtatatgggaggcagagatgctatctttccactattggtactgtgtgtgtgtgcgagtggtggatcctgctgcatggctgagtgactctgcaatgggttttttttttccagttttagtatggtacttgtcctgtgccttcatttttgggattgggccttgctgtgcagtgagcctgtgattactgtgtttcaatctttaaaattattactgtgtgtatagtattttttttaaagataatggaaatgatttacacctccggtctctctgccaacaagcatacggccaaggagtcgagaaaagataaataaaaatactcgaggttatgggacaaacccctatctacgccctgattatatccagctgattactgtgtgtagagtagaatcatcttctgtgtatatgtacttttttttttgtatgtgggattttttgtgtatcctgcgagtagtttatgcaacagtgtgctaatttggttttggtgaatgtttgggatcaggttccatgcgctctcggagtttgatcagaagaagaggagctgcaggagacgcctgtatgaccacaacgctcgtcggcggaagccccagaccgacgtgttctcctatgcatcggcaaggccgccgtcgtcattattatttggtaatttgtctgtaccttaaatggatttgcaacagcagttacttttcactatttagcttgatgtatatgatgtatgtgaaaaatggtaaattgttggtgataagatctttataaggttactcctcggcaacctccacctaccttatccttaagcacttgcatgttcttacttgatcgatgggactgagcttacatgtgaaaattattttcagttcgaaaattcttggttgtaagttcgactccctgattaaatttattttgatagtatcaggattactcgcaaagaaactctacaatatcagatgttctatcaagttttctataattataccctattttccctttcaattaagattttccttcacaccaaaattgaaatgccactgcagatgataaccgacaaataagttttgtctggaacaaagctccactcagccatgtaaggcctttcgcaatttctccatgggaaagctcatctgaagttgggacaactgatggacatatttatttggataaatctcacatatccaaatctctcccagcatttaacaccgacatagatgagctcttaccaatgaaaggtatgattttccaaagatgtaagttttcgtgaaaaatgtcatcaattaagactactttcatggttcagcacattgcatagatctttgaaaaaattcaacctatacactgtaccaaatgccaaattcagatgctgttttgtcattgttgttgtttgttaaaaaaagtatcctggagttgtgcacacccatgaaaaaaaattagacccttgagcacatttgggtttagaaaataagatggtgtgcagtgtgctgctaagcttatgtcactatagttgacgaagtgtttcaaacataaaagacaacagagtttttagtaagattctaattggaaaagaaaaaaaataccgtgttttgtgtgatagtaaacatcctacagtttcaactatataagtagttctcttgtggtcattgggcagagaattacttctccagttagcaatacaagttgttttgatttaacttgcaggtatacaacaaagaatgatgttgggcattcttttggtcctttgctctcttttgcccaaattagttatgttagatgcttttaactacagttaatatgtgcttggaagtggagcatgcaccaaaaaatggatagcaaatgccacaagtttccatatgaggctttggcgctaatatcgcatcaatgatgtgttagtttttgtgtttggtacaagtatctgtacaaggttttggtgccaacattgcatcattaatgcgcagctagttgtttcatttggtgtgagattgtatataacggcagcaattattttcatgtaatagtattccaacagggatttaacaggggcagtattgtaccaaaaaccataacttaatgctatgtgcttattagtctacaacgacttcgaagtgctgactagagggggtaattatatttatgctatgttttgttagataatggaatgctatggattttgataacaagaaaaaaaaatgcaaagtgattccagatagctgtgattcttatctctgacaaaacgagggaattccaatacttagcacaatatgcgaaagtcagctcaggaatgccctaaatttaccttattatgcctgttccctaaactctccgcatgcgggagaactagttaccatgctaaaattctacatactaccaagcatactgcaatttcttggataaccttgctaattttatgctaaattctcaaaatatatttcaaatgaatatgagccattcaatccatttccattgcagacttctctgcagccactatttggatgttcttcggtgtcctttttatccgaactgcgcaggagagctgcatgtcatttcattaaggagaaaacaatgtacatattttgatggaagaatgaccattattccattttgcaggtccggacgcatctttaactgcttcaaaatttgatggagcaccggatcttcagcgtgctctctctcttctgtcatctagttcttgtggattacctgatcctgtacagcaagcatctcgcgtcatccaattcacaggcgccagccaaaacaaccgggaacttcctccacttaatggagggaattctgcttcagcatcatgtgccaatgtacaaactatagcacaaccggctcagctggttcgttttaccatgaatgctagcagcaatgcttgtcagtccaatttcttcggtttaaaccagataaactaaaggcctggactgaaagcccgtcgtcgatttcgaccaatatccaccaaggtggccttgagaagatacaagaattgcttctatcaactatcagagtgcaaacaatgtcacagttaatgttgtcatcataaatatcggtattggtctcccctgaactaaaatcgaacggagtgatggcttgcttgtgttttcgataatcgttatgcagttctaattttttttctattgttttctgccaatgtaccgattttcaaactgtgggtcttgtcatttatacttgtacaacctaatgtcaaaatgtcatgtatctttgaaactgtttttgatggatttgggacatggtttcgcttgtatgattgttgttttggcagcggcatgtggtttcagtggtggtggtatgctttggcgccataacgtgctgttttttccccaagaaatgtaacttcataaacgtgtgcaaacagaatcgatctggcaatttgccacgttgtgcggggaaaatagaacaatcctttccccaaaaaaaaatctgacttatcctccatttaaattgcacttgttttatagaacgtgcatccgcataacatctcccgttgattgacgtaatcaaagaactatttaattgtatagttgcaaagtaaatgaaacagtcttgtctcctaaaagaaaacaaatcaaacagctcaagagtcgggggatggaagcagcagcatgtcaccatcacagttgtgttggtacaaatctgtcttgactcgtgatcttgtggctgaaatcttgtgcctactgtcaaaaacagcaacacaagccactacacagctcaacaattgtatgattttccaacagaagccaccaacataattgctcagatgaaaatttctaatttctttattacctctctgttgacgaaaactctgttgctgtcatacactgcaccacaaatataagaccatatgtaattcaacaccaagaacaggggcattcagaaatcaacagagcaggcttggttacaccaacaagcagatgttattaacataggaaagctccattagatcctgttaacatacaaggcaacatctatattccagaagagattacttgagctgtgcaactcacacaagatagaatcgaataacacagaagctcaaagcctaggaacttctgtgggcacacagaccctatgagctggtactaatgaatacattgagattgcctctttcttcatcctcccttgcttcctccctcgatccatgttgtaatcatctacattgctttaatttcagtcggttgtcatgggctcagtgatgcaacagcggaagcgtgctttacggacattgctcagaatctccatctctgcactctcaagcatacaaacgatatcagtaaatgcggggcgaacttcagggttcgcatcccaacaaagagtcatgatgtggcttagagcaggcaggcagtcctgcgggatcactggccgagcacccttgttcaccacagcaaaagctgcctgaacagccgtcatgtttgtgaatgggagcatgccagttataagctcccacaagacaatcccaaagctatatacatcaactttatgatcataaggcctgtgctggatcatttccctgaaaacaaaataagccaaccagctcatcaactaaatgcgtagagtaatattgatattgggttcttgtttagaaattcaagattgcataagaaacttgctactagtgtgtcaacagcaagacaaacacttatctctcctttcttttcatataacaaaagaaaatttcaagcaaaaagggaaagtcttaatgttattttctgttaatggtaagtaactataaccaattcaacagtgcatcagtatgaactaaatgggggccatattaaatacagaaagaagattgaaaacaacggacctacttcatcaatgttgtaacaaggttaatcaattcactatgccatgtgtaatcctctggtgtgattcagttgatttgggatgccacaaaacactaaaaatctggaatgagatgcacaaataggtctacataaaattcaactactccagaaaattgcagaaattgatgtgtacaatggggtatccaggtatattggtaaaatacaataatcctacatatctgaagttataagtgaaaccatccgcaataagtcagcaacagatgtattcaggaaaaaaaatcagcaacagattattgacaaacagacagtcagataccattctaaagtgaagtccttgcaagtgataagctatacatgagttggcatatacaaataacacagggagaaaaaaataaacaggggaatatataacttacggtgccatccagcggtaggttcctgtctctggtgtcataccctcagtttttacttcgatgcgagccactccaaagtcagcaatcttaatggatttatctgcggcaattaataggttatctgacttcagatccctgtggataaatcccaaagcatgtacataggccatccccctggctatatccaatgcctgttttacagccaatctcaaaggcactgacttgttttgccttcttgccaggaactgccggactgaaccacctttagcatactcagtaatgatgcaccacacaattgacttcctacatgcacctataaacctcacaatgtttgggtgcctcagtctagacaacatcataacttcttgcacaaattgttgctccaatgcttgtgctctctctggatcattctcaggcttctccagtagtttaatggcaacatcttctccattgtatgttccccggtatagcttcccaaaggccccttgggcaaaaggaacccccatgtccaacctccccaaatcaatggcccattcctcataattacttaggatctcagtcggatggctcggatccatcaaaacacgagctaacgcatcctcatttagcgtgtgcgcagccacacggttggggcggaagacactgttgccaaccgaatagcttgccgtcggggcatcacggaggcctgggtgcttaagtataaccgtgcgggactcgttcgagccaacgctgctgttgtccaccgacatggcaacggaacccccaacgtagttggccatgttgaagccgtcggcgctgtcaacagacatctgggagccctccacaaacttatggtaagacggcatgttgaagaggccattgatctcattatcttgcattcccttgccaccaccgcctatcatatcgtgaaaccttggctgcccgttcatgtcgaaaaaaaataaatccaaccgcaaatattatttgagccggggcaggctgttcatccttgtacaagaaatgccctggttgtcgctcccgctacctgcaaaacaagctgaacttagtgaattgaggcagaaacaacacaaaatgcacttctagcttagaatcacagtaacatagaccgcgagaaataacccaaaatgttcgacattaacagataaaaatccctactaaaaaactactagacctttctcaattccacgcaaaatctacaccgacgacctaaccctccttcctacaacaacacgaaacctcatatccaaaccctccccaacccgatcgcccccccccccccccccccccaaatcccctcccaaatgaaattccgcaaccaagacatcaaaaccccccatcaaattcacgaccctaaaaccatccccccacctcctaatcgcccgaaacccccctccaaccaaaccaacccccccccccccccccccgcgcccgattcgcaccaaagcctcatgcagtcaagctcacctcagcagcaggaaaagctgatcggaccagcttgcagccccaacccccgccgccctcctccgcagcagcagaatccgccgagcagcagccgcgaggggaagaggaagaggaggaaaccctaggcggattccgagtggattggcgtgtggttgggttggcttggcttcgcctccccttttgcttttctggagaccggagagcagagacgacgactccccaagtgggaaaagaaagagagagaggaacaagtcgttagtgtcattttcctcttttggggcaaatttcccgttttgccccccgtacttgcgagaaattgaggaaattgcccccccttcaccgctttggcttggccttgggccctccctctcctgtcattttcacggcagctataagagagaaaataattttggactttttagtcatatcgtgatgcgattttaatgcggtttgtttaaaatataaattatggtgtggagaagaagttaatgcaactgtgcagggcaataaattatggttgcttccgcagttatgatttgtggaacaataaatttttgcactagggagttattattgagtttaatggtgggggtgaagttaatgaagtatggtgcaaacttatgacaattttgttttttcctccacaaaaatgtatttatttagtactgctcatgactgaactctagtcaattaaagcattaagttgtcctacttttaatcacgtttaaaacttcttgtagcatcaaattatgtaactaattaaataagatatcattgttaagcatcaaattatgtaaggctgtgtttagatcaggggtgaaaatttttgccgtgtcacatcggatatatggcacacatttaaagtattaaacgtagtctaataacaaaacaaattatagattccacctgtaaactacgagacaaatttattaagtctaattaatccattattagcaaatgtttactgtaacaccaaattatcaaatcatgaagtaattagacttaaaaatccatctcacaatttacacgtaatatgtgtaattagtttttttctatatttaatacttcatgcatgtatcaaacattcgatgcgacattatgaaaaaacttgctagggatccaaacatgccctaaatgtaaatactcgagtataatgtgacagtttgtgctaaccatgcttaaggctgtgttcggcagcctgggttgagaacccatatctcgcgtatggaaaatagagcggtccattagcgcgtgattaattaagtattagctatttttttaaaaacaatataaatttttaaacaacttttgtatataatttttttgaaaaaatagactgtctagtagtttaaaaagcgtgcgcgctgaaaactatactgaggagttggaaaccagggacaacgaacacatccagactgcgttcagtagcaactgatttgaagaaaaactatctcattgttcacacacacgttcccaaacttctaaaccgtaattttaaaaaaatataaaagtttatttaaaaaatcatattaaattatttttaaattaaaatatttaacacttaactaattatacgctaatgacacatctcacgcctcctctcagaaaaatacccttatacagcaaaaggaaaaatcttctttttttctccccttctcctactttccagtgaggagagtgtcagtgcgcgcgccggcggcgaccgagctggcggccatggccatggatccggacgccgcggagtggccgtgcatcatccaggcgctcccggcgttgccgccgtcgccgtcgtccaccggggtcccgaggctgccgaccatggtgcaggcgctcccggccgccacggacccgccgcccgccgccgccaggctcaggcgcggcgccgagccgcccagcccgcgccgcacgcgctccggcggcgcgccggagtggacccccgcggagacgctcgcgctcgtggccgaggtcgcggccgtcgacgacgggtggtcccgctccgtctccgccttccagaagtgggccatcgtcgccgagaacctcgccgcgtcgcgggggagggcggcgcgggggagggggagggggagggcggcgagcgagtgcaggcggcggtgggaggcgctcgccgcggagtacggggtggttcgccgatgggaggtgcggggtgcgggcgggtactggcggatgagcgccgccgccaggaggaaggccggcctccccgccgacttcgacgccgaggtctacggcgccatggaggctctcaccctcgtcgaggaggcgcttctcgccgatgccaccgccggtgctggtggtgctgagattggtgaaaagagcgccgccgccgctgaggtcggagaaggcgacgaagttgaggctggggaagaggatggaaatggagatcgcggcgaggttggagaagaggatgaaggtgaggttggagaagatggtgaggaggaggatggcaatgaaatggtggaggtggaagacgatggcaacgccgacgacaaagacgcgcaaccagatggtggaaatgctgctgcttctgatgatttgggtatgtttcttgtctcctttagcttttcatgttcatctgcctggacattccggtatgctagccatgtgcgccgaatcggatgacgatacattgttgatacttgatggtgaagaagtaaagctctgcggtttatgtcacatattagatggttattttgtttgagtgcagtgcaatcatgtggcattgcaaggatacgatgtgaaagcaattcggagataaggggatatggtgaattggtgatacctaactgaggattagttcatcttcatactctatcagatgatttggccagtggaaattttgccagtgaatatggtttacttctctaaatgtaggatcaggaattaaggtggtttatgggttattgagacaaaaatatctcatgatacagttttatttttttggaggaagagaggttcctctcccatttcattaacgaaatgcagatgacaaagtcttttacaggcactagtctgactagaatgacattcttatttcctcgtgtccagcacgattattgttccttgggcttggttgacagttgagattatatgcatcctcgatggtgatgacccacaatccagattcagtgcacctttggtacattatatgtttcatattaagatataatatagttctagtgtgcaggaaattgttttttaccacgttatgatttatagagctagcaaacactttttgggtagtcaagtcttaattttcatgtgctgggatgttatttcaattcaatgccacgatgggcccattcttaagttttaactgagcatggtttacttttctaaaataaatggtgcaggatttgttaaaatgcagtaagcctatacttggttatattagtttcagcttctgaaatctggaattttgtagttattttcaaaacggttgtggcaaaaggatctatgtgaagccaatttgatatagtatgtgaacaggaactgctatttcatattcaaatcactgaatgatgcaggtatgcagggtcaacatatgagttccagtttaaatagtattagtacatattggtacctttccaaggatggtaaaaagactacataataacgtcttcaccaataaatttggctttggtacaatgtcttccttgtttacgatataatagtgggtattagtttgctctaagacccttttatcttcattgagtgtacaaagcaccatactatgcttagctacatgtgtaattctgtttcatactatcagctagctagttcagtttatttatgtttcctccaagtcacctgacatcttttgatgacaccgtttttgtgttatgtttgtctagaagtctgcgaaacgggagcaaacaacgagggcaagaaaagccaaaccgatgcatgtgaactggccaacaagttacaagagaacgcgcagcacatccatatgctactcaaagaggaggcaggcgaaaatgagaaccataaccttgctatctcatcggattctatggaaaccactcgccaaaaaggtgatgagctgatcaaatcgctaggtgggcttgtgagctacctgaaccaattcactgatctgatcaaggagaatggattcgagaatgtcgtcggtatgagctgatctgtgatgaacaaactctctaggatgcagattccctttgtgagggagggttaaatcagactgccaaaaatctttggcgttcttccttccccgtacttgtaaatatgtgtgcactgtaagatgctttctaatcaaatgctgtaggtttgtggcagacattgctacctgcattggcatcaccatttctcagcgccattgtgtacttcagtgtctggcaatctgctgttctggggcgtttctctgcactgtacagcagaatcccaggtacatttttgcatgtacctctacatctgggctctgcaatattagcatatacacttatgtgcatattgcgagctgcatttgaataagtactccctttgcttcacaatgtaagtcattctttatgaatgtgagaaacgctagaatgacttacattgtgaagcggaggaagtagtttagtaaggctaaattatgtctctccgaggaaacaccgatggcgtggtgatgagccatggatacatgagttcatctaccagggttaatatcctaatgcctatggatatcacacagacatgattacgcttttaatattttgtaggattttagtgagtctagagatttaccattggtcttattctatttaaacaagtgttaagggatgtattcgtgagcgtatgatatgtgagagtgcagtggtgtgtgttacatgtaatccaaagaagaaaatataagactatccattcatagatttgaatggttagtatgtagctccaaaattaatctagccacaccatgctgtgctgagcagagtggctgtgacacaaactattcttagccctcggcgatcgcgcgttttctcccccctccctctccctttctctagccatgcacatgcaaaagcatagccacccactgccttctccccccaccccgcgtcgcgccacggtcaccgtcgccggccaccgccccgccccgccgagccgagccgaagcgccatggcgcggcctcggccgcccggcctcatcgccgtcgctgccgccgccgccctcgtcgcctggtgtctttgcgggcctgcctccgccgccgccgccgccggtggcgaggcgggcggcggcggcgcggggcccgagggcgacgtgctgatcgcgttccgggagacgctgcgggggccggacggcgcgccgccggggccgctgcgagcgtggggcacgccggcggtgccgtgccgcggcaaggcgtcgcagtggttcggcgtgtcgtgccacgggaacggcagcgtgcaggggctgcagctggagcggctgggcttgtcgggcgcggcgcccgacctgggcctgctcgccgcgctcccggggctccgcgtgctcagcctcgccaacaacgccatcgccggcgcgttccccaacgtgtcggcgctcgccatgctcaagatgctctacctctcccgcaaccgcttctccggcgtcgtccccgacggcaccttccacaccatgcgcggcctccgcaagctccacctctcctccaacgagctctccggcccgatccccagctccatcacctcgccgcggctgctcgagctgtcgctcgcgcacaaccagttcaacgggccattgccggacttctcccagccggagctccgctacgtcgacgtctccagcaacaacctctccggccctatccccgaaggcctcagccgcttcaacgccagcatgttctcaggtacgcagatctcgatcgatcacgacgtcttcttcttcctcctccgattcacgccattgatcgattcttgatcttggatttggatttgggtttgatcaggtaacgagtatctctgcggcaagccgctcgacacgccctgcgacaagctcgcctcgccgtcgaacatgtcgacgttcatgaccatcgccgttgtgctcatcgtcgtcggcgtgatcctcgccgcggcggggatcgcgacgggggtcatcggccgcaggaggcggaagcggcggcggcgacgccccgggcccggcgagcccggcggcgaccagacgccctccaacccgaagctccacaccgcgccggccgtgaacatcaaccgtggatccgccaccgccgccgcctccacagccgccgcagctggaacgtcggcctctggcggcggcggcggcgcggcggcgaagcgaggggggagacgggacgagcacgggcggctggtgttcgtccaggagagccggaagcggttcgagatcgaggacctgctgcgtgcgtcggcggaggtgctcggcagcggcaacttcgggtcgtcgtacaaggcgacgctccaggagcgccccgccgtggtggtgaagcggttcaaggacatgaacggcgtcgggcgcgaggacttctccgaacacatgcgccgcctaggccgcctctcccaccccaacctcctccccgtcgtcgcctacctctacaagaaagacgagaagctcctcatcaccgactacatcaccaatggcagcctcgcccatttcctccacggtaaccaaccattcattcctcaatctcgcaacaccatttcgtcttaccgacaacgttcaattccaagaaatatcatcgataagtgcaagttacataaaatactactctctccgtttcaggttacaagacgttttgactttggtcaaaatcaaactattttaagtttgactaagtttatagacaaatatagtataatatttataatattaaattagtgtcatcaaatcaataattgaatatattttcataataaatttgttttgggttaaaaatgctactacttttttctataaacttaatcaaacttaaagcacatcttgtaacctgaaatggagagtatcgtacatgcgactttgttccagaaaaatcatcgttgtaagggttttgttcatcccgcaccgttgaatgcaccgtttatcataactagtgataatagtatttctggaacaaaatagcttgtacgatcgatagcatttcttataattgaacgcttgtcttggatttttttctcttttttggcataatgaattgaggtgagatttttgtaacagggaatcggggatcggagttggattgggggaagaggctgaggataatcagggggacggcgagggggttggggcacctgtacgacgagctgccgatgctgacggtgccgcacggccacctcaagtcgtcgaacgtgctgctcgacggcgacatggaggcggtgctgtcggactacgcgctggtgccggtggtcacggcgagcgcggcggcgcaggtgatggtggcgtacaaggcgccggagtgcgtcgcggcggcggcggccggcaagccgtcgaagaagagcgacgtgtggagcctcgggatcctcatcctcgaggtgctcaccggcaagttcccggcgaactacctccgccaggggcggcaggacaacgccgacctcgccggctgggtcagctccgtcgtcagcgaggagcgcaccggcgaggtgttcgacaaggacatggccgccgccggcgccggcgccgaggacgacatgctcaagctgctccacgtcggcctcggctgctgcgacgccgacgtcgaccagaggtgggagctcaagacggcgatcgcgcgcatcgaggagatcagggttccggaccccacccccacccccgccgccgccgctgacgccgccgagccctcgccgtcgacgacgacgacgacgaactccggcgagacccggtcgtaacgtaacccgatacacacgcgtatacgaaatcaagcagctccaatgatcgcctcttggtcaacggtcagcgccttgcatgcgtgccacgtggcatggtacggtgagctattgcatgggcgaaactgattggtggttaatgagctaagcatgaagattataatttaacccagctgatgcatgcatggaaaattcgagcgtgtgtagaattgattttggcagaaattggtttagcttaatttaatgaagggatatatatggctagctaagttagtaattttttattttgctgtactgattagagtgtaagagttaggaaattaagatgttgggatattttttcttttcctttttttcttcttttcatatatacatacaaatttgttgttacactggaatttgttgctagctcgtagtttaagctccttgctagcttgtagtttaagctccttgtataaactttcgaagtataaaattctcagatttttgccatagattcgtgtgaagatttgcctcttgtacttcaccttttccgatattgattttgctatttcacttatatgatagaattttagattcatgtctttcgatttttcattgtaagatcttgcatcaagattattgtagattcaatttgtagttacattcaaatagagagcatttatacttggttatagaatacttacactcagttacagaacatttacattatgttacaatcaccaaaattaaattttgcaacagtttgtctctagattttgtccttttttattttactcaaaagggactatatccattgattaaaaaatatataaaatttgaagcttcaaatctggcatggttccttccaatattcttcgaagacaccttttccaatccagttcgtctctaacgagtagcttgggtagtaagtggttgagatgggccgagatgaggtccacaacatgacgacctcattgaacatgggcctcacattatgtgggccgaggaagcccataaacgggaatgcaagctgcgtgcaaaaaaaaaaataaaaaaaaggaaaatattaaagaaattgcttctctctcgcgcatgcgccctgggcgttggccggccggccgccggcgaggtgtcgtcggcgccgggcccgccggccgccgcgctagccggagacactactagtagtcagtagcccgccgccgctgtattccctactggcgtgtcgtcgtctgagtcccaattcccaacagcaacggctgcacgcacccaaggtgttcgagggattgccacgccggtggccggcccaagtctccgggaaatctccgtccttctccggggggcctcgccggtaagccgcggcatagcagcggaaagctcgatcgaatggcccaggcgctgcagatactgtgctgggttcagaggcagcatacgctcgccatggctgctcattggctgtccggaccttgaagccatagaaagatctgcttgctgtaggctgcacaaggtggcgcggatgaatgtatgcatgatcgcctcttcatccaatctgagcatcaggtatggatttcaaattatccaccggacttgggtgcaggattttgcgttttgtgttttcctcgcttcttgggtttctccgatatctgatggagaatatcaggcagctgctgatataaaagactcaggtagtgagtactcagtttgagcggaacctcactttcaacctgatataaaaaagacagtcaaaattttggcagtagctagacaaaacatttttttttagaggcagatcaacattactattgacccggcttttgggagaaagccaaatgtgaaatcaggaaccagacagaacatatagttttgagttccgtaaatattattgtcaatatatatatatatatatactccctccgtttctaaatatttgacgccgttgatttttttaaatatgtttggccgttcgtcttattcaaaaaatttaagtaattattattttctatcatttgattcattgttaaatatacttatatgtatacatatagttttacgtatttcacaaaagttttgaataagacgaacggtcaaacatgtgctaaaaagtcaacggtgtcaaatatttagaaacggaaggagtatatgattttggactctcagaagaataaattcctaacgaacttttgttggcacaagaattcaaaatagatagtgctaataggctaatagcctagtccgcgtagtaagataacatttcagtggaaaaggtcccaaaaaaatccttttgaactttctaagcagatttaacatggtactattgcactatacctgtatcatccacagatttagccactgttagttggttggtgctccactgaacttcagtgactgaaccactggtgcactgtacagtgtacaccacacagtagtgtctctgcagttacagtgcagctgcaaccaggtttagccaacaaaagaagtactcccttcgttctaaaatatagcaatatagtatagaattggatatacctagcactttctaaaatatagcaatatagtatagaattggatataccctagcactatgattcatggatggaggagtggtattcagatggaataagttgtctcaagaaagttttatctgtttgtttgggagagcaaattagtacatttttatgtcgcatcagaaagattgtggcgaacaaatgcaaaatcgtcaggagctgtcacttttatgataatgcactactgtgctgcacaatccatgcatataagagacagattattcgcctgaatttaatagcatctgtcgtttcattttgaaagggtaggcacacctgcagattgggctgtgatgccaggcttgccagctatatagctcactaaagagagaattgtgatcaagcctagccagctattagggagttagttaagtataattgcatcaggagagacgcgtacgcttaagattatgatatattgagctttcagggttatcatatcatgtgcaggcttaattgtggacggacatatcattcacagacaaatcgggatcactcatgtattaggtttaattagggtgcatcacctgcagacaaggactgcataatgctagaatttcggacgtaaaaagtatttaatggaaaaaagatttatacgtagtcaaattacaactcttcccatgtagagagcacactagtgaaaggtgagaggtgaaaataagttttaaataaatttctgcctcaattagtttatgagtagctaggctagcttataatgaaatatctttttattcctgcttgctatcgctttattaccactagtatattatgatgaaatatattttttattcctgcttgctacttctttattaccactagtataaggtgataagaataatttgaatgtgcttattggctcaacgagtgacattgatttgtctcctctttatggcctgatcgcatcgtcttagcatcgtagcaaggggagaagtagtggcattgatcattaaagtgatggtaaaatatatttgtttctttctggaatcatttgctttgcacatttgataagttgccaatttgatgaagcatatcatttatagatttaacatgccggtcagtaacttgtaatgtttctgttccatttaaacgcatcatgtgtgcatatatatttatagaaattctccagcttgcttaattatgtcagaatacgttatatttacaaccaattattgaccatgttggtttgcgcatcttagttatacagaggtgaagtgttctcaataaacgcatcatgtgtgcatatatacttatagaaattctccagcttgcttaattatgtcagaatacgttatatttgcaaccaattattgaccatgttggtttgcgcatcttagttatacagaggtgaagtgttctcaatatgattctatcacctttatgtaatcgtctaagatcaataaaaactttctttatcttgaaaaaaaatatttcaccatgggagcaaattaagtacaaaagtatatagcaatttcaaatttcaggtctcaaagaacgctatcctagagtttgtatgctaggtgaaccccacaaaaacaggggaatattgtaggtgatggacagttggtggtctccggcccttacattgtcgagttcatgagacctaacataacaaaggcagatggtcacgaagaatcaatacctgtggaaatgcaatgtatgtttatacgaaacttgttaaaacttttctgtgatgttgtataccatcgatctttattctgttcctgtcttagctttgctggagcgtggtacaaggcgcatgttggttcactcttttgctgctgaatcctgaatgcacgtgtactgcataacaaaccaacaaaatggaaatgtttataactcaattgatgttatactgtattaattttcagccttggctgactaccacatattgatcatgttctcatgtataatatggaatttgtaaaacctgattctatagaattttaatttcttacacagttatagctacatatcttatttcaaaagatttgccctatgctatgcaattcttgtacttactgttaatacgatctacactgccatagcccataatatggatgtatcacaatcaacagttgctgtaatacaatagtacttgttttctcctgattaacattacaagtaatttttaagtccttcagatcctagcacagatgtctcttttggtacctgattagggttggtgattgtgcttattaaatcaattactctggccatgatttctgtcgagctatggtcgttggttgtctacatataggcaaacacatgtcgcattttcagatcaacctcacgtaccatatggctgatggtcaccagtgaaaggaagcatttaaatgtggtttaacagtgacccatgtatgtactactcccaccatcctaaaatgtttgacgccgttgacttttttaaaaatgtttgaccgttcgtcttattcaaaacaattaagtaattattaattcttttcatatcatttgatttattattaaatatgctattatgtatacatatagttttacacatttcataaaagtttttgaataagacgaacggtcaaacatgtttagaaaagtcaacagcgtcaaatatttggggaaggagggagtatatcacaggtcagttttctcaaccattggttttcaggtatattgggaacgcatgatgcgtgtcttggatggatttattgtgcttgccgcccatgagaaaagaggaagatattgacagatgagttgtgctaaaagtacgaaaaaaaaagggtggcacattttatatcaccaagcaatataatttcttaattaggctcactaatatgtctagttaagtatgacagaattaaattgacatgagcactaaacaattttaccatacttgatttataaatatatgagcactcgcatttatcgaatactaccttaattgtcagagtttgtttggaacacatgaatttcctgtagagaataattcaagacctgcatagatctgtcaaaaaaaatcttaaggttctaatcagtgcctttaattaaactgtttaattggagcatgtataatactgtttaattggcacatacatgatgattacaactttgaagcgttgggttccggttgtaatatatacagcgttaggatttaccttttctttctgcttgatgacaacacttgcaagtgacatgcaaatgtgcaataaactttcctctattcttttcatgacgatcgtgacacagaaacagagagagccgtccacattggatcgatcacaccaagatatgttttcctaatttgccctagtgcttttagaaagttcacgagccattttgtcaaaagaaagaaatattcaggtaaaataaaaaacgaaatgctttaatagaaagagaaaaactggctttaataatcatgttgcaaactaactcttttcttgttgcttcatcgcttaaaatttcgcaaattaagggtgtgtacgtgtgtgcatctgatgatctgaataacaaacaaacaagtttatgcaggtaaccgtatgcatgagcaatatccatcgtatcatcccaagagaagcaagcaaagatagcagagctaaaaattccatgaacatgcaacaaaacaaaatttcagcgaaactgccgaaaagcaagtttgtatgtttattatatataggtgtacacggacaatctaccataacaaacatccaaatgctcaacagacaaagctacagtactccttccttgtacatcaatcacatttgatcaccaacactcaactactacaaatcatataaattagttttttttaaaaaaaatcataaaataaaactatacattacaaagttttggtggagaccgctggattatactcttacggtcttacctcataaagagacaacgatcaaccgatcatatctaatctatgcaaaatttaagaattttcggatgcacttaaagaaggacaagtccttgattctcataagataaataatcgatattgtggaatattctccactaaatatcaagaaataaaaacctccacagaaagagctcccacatgtgcaacaccactaaataatttaatccctaacaaacccaaattcccagctcccactcacccatttgctcctttaaaatgttgccaccaccttctccttccctcctctctctctctctctcttctctcttctctctctccataaacctcaccattggtgttcttttaatcggtgagaaagcaagtgctccaagaattgcaaaggggagaggagagatgagagagtgaagaacaactacataactaaagcatctctctctctctcctctctctctctctagaacacaagaacaatttagcgattactagctagtgttcatcaaaactgaacttggacaagaaatttacctaaagttagtattccacgatgagctttcttgagcaggcaaccgagcggaaggcaccaccgccggcgaggctcggctccatcaccaagctgacggcggcatcgtcgtccttcgccaacctcttctccaccttcctcgggccagtgagctcccccgagccgaggccgaggcgcagcttcgacggcggcgccaccggcgtcgggcttggcatcgtcgcggccatgagccacgcctgcctgacgaccgaggccgagccgatcgccatcggcgcggcggctcggcgccgcgcgagagaggaggccgagctctctgagagctacacttgcgtcatcacgcacgtcgccggcgtcgatggcgccagcggcagcgtgaggaagcgggtgtactttgggttcggcgacggtggcggcggctggcttgtggaagccgacgaggagccggcgccggcggctgacttcttgagccggtgcttcctgtgtgacaagaggcttgatgggctcgacatctacatgtacaggtaaataaaatttcatgcatcataaaaaatatcaaaattttgatgaaaatagtactatattgttttgacaatattatacttattggcacccaaggtctactttatggactattctatatattgcttaaaattttcaggagcttaaacattcattttggaattctaattatatttttgtatttattggtaacgtgaacctgccattaactgcgaagcacacagcaccttagtataggtgggaaaaaaattcaaaaatagttataagaagttcattatctttccagaaagcaattggaaatgccaaatatcatacatgatacattttaccttctaagttttacctagtatttttttttatttctagctttttggttgaagaggatgttacggttttgtcttcctaaaagattaatagagtatgtagtttgtagctttttaattatagtgaagttgctttgtttatggaagacagctaacctgcaatacatgtaaaaagtatatagtatataagtctctagtcaatcagaaataactagtggacatacaccagatcaatatacaatgttatataacatggatccatcataaccgtgcttatgttttcttctttttcctgtgattagcatgataatctctagcctaaagagtgaaagtgaagacttttccctgttgcttcaataaataacagatcatattttattctcccttttaactcaattcaaaacatattcaatgtagaatgggatcatcactaaaacaacaagttcaccaatcacatttttagatgtcacacattgctttgcaatattactagtactcgttaaacattggaattgtcaaaagtgagaaaaagtagagcaaccacttacgtcattgtgcatgtctcaaacctgtaggggggagaaagccttctgcagctccgagtgcaggtgccaccagatgctaatggacgaccatgcagacaactgtggatctgaagccctcaaggccaacgactactcggcctcgccgcactctgcgccattgcccttctccctcagcgtcgcagctgcctagtcgatcgaataatcgactgcatgatgtagcaccgtcaggctgctcttcaattctgtagcagcaaagaaatatatagagagaggtcaaagagatcatttaattaagcggatgaaacatataaagagtaatcactagaatgcttcttaactgtggcttgaataaaaaaaaatggagaggattctcacactaaagaaacagattaaacagatgaagaaagttttgagattatatgctcaccgcaagacactggaaacttcgtgcttgcaatattatgtacgagcagaagtaattagtaaaggaatttgatgttatgttctcttctgaaatttcagtaagagagagtgtattacatatcaggtgcataattggctcaggtaaaagttttatggtctagacgacagatttgttctaatgaataaccgaatttcagtatttcaacttccagttctaattaagcactggtaaataacaccagaatctgatttctagaggcaaattttgagttgcagatgagatccatctaagttacagattgtcacaaaaaaacattgcctcatctatcccaaccacaatttgcctctagaaaattgtcattcttgcatctatgtggaccatatggtccatgcatgtgcaggcacattattttcatatctcgtagagtgtactaggtgcctaggtaagatcaacttgcaactttgaccattcttgctcacgtacactatggcagtatcacagatgttgatgcatcaggaaaacaccaggtcataaaacctgaatcttagtgacatcacttgggagttgggaccatccattacacagcagtattggtatgagcatgcaagaaagcttaccatttatcaaacaaacaagataataagtctgcagttgttcttactaatgtattgccctattttgctactccctccgtccaattttatagaacgtttttttttaatttggtgtagtcttcaaattaaactttaaccattaatttctcttacaatatattttcaatggccacaaaaccaatatcgtgtaaaaacactctcaaatacgaatttattaatataaattttatagactaaacaggaataaaatttgactaattgttggccaaaacttgaagactttggggttcttttttcaactacgcccaatgcttatacaaactgaagaggggtagaattttttgtacttcttttgacagaaataacagtttttaatccctggttgtaagtcatcaggtgtacacaaaaaggtagcaacagtgcggtactaaaaatgtccgggaggcacgtgccaatgtaggctgctttcatactgacctggcacagaatttgctcccaggaatagtttcttggtggaatacgagaagcttggatgtgatcttgccatctgtggaattagattctatggccattcactccatatcaagaccacgttgagcaccatttgattcactcgatcagcagcaaacagtagcctggaatggaccgaagaggagagtctggcacaatctgccttctctgcatcttgagcatcacaattcacatcagagaggaaattatctaaagacgtacttgtggtcatcatcaattctgaaggcaatagaattatcaggcagactagcaaatgcttcaacaacagcttgtatggttaccacctatacatgaaaacgagaacatgatatgttaatcttcttagtcacacactgtaaaataaaggaaatgagctaccaggacgcattaactcgcctctcaggtgggcatagtataggaaacaagctattttatctttcacatttctgtgatgctgatacaataagggggcagcaaggaacatctacacctgttcctgtctaccattgttcttcagttgcaaggaacatcagttgtcacccagtagcaatagctacctgtctaaaatttgaaggcgtacaaaactaaaacactaataaaggaagatgagcctcttaataggaacaatgcattcaaacaattcaagttcactaatacaccgagtctttctagctactcatccatgaacaaaccttgatgatacagaatgatggtttgaatattttacttttttgcatgcacatccccctaacagtaactttgttcagaaaatattcattgtcgagctaagaaacagatttacaacacaaatattttgtggaataattcactgtattttgaacaacaggcctatcaacaatatcgtagcatcaggattgatgagtccatcagcagtgcatatccaaaatgtaaatgctaccctgcaaataatgaagataagagttttgcgggaagttgttatatccactcatcacagaatggaaaacgaaatgatatgcaaatctactggtcatatttaacctagtctccatagagactatatgccaatatagagcatctgtgtaaagcatttgaaagaatttgttctgtatccattcaacagatgaagcttaaagacttaaatctattccatcagtcttcttgcccccaaaaggtctgatttggtcgtattggatgctttgtcctttgttctaagaaaagtaaagaaattctagtgtgccaacatgtggactgcacatgattgccatatgaaatgaaaacacgtaaggaaacataacatcagccacataaagtacagtacttgaaaagatcgtgtacatctaaaagaaaataagaaggaattaggtaaataggaaaatccaaagattatttcattgtgtttactctaaaatgcggtaagcaattacatatttgacaaaatataggctctgatatttaagcaacccctaaaaaatgttaattcatggacaaaaacaaggtttactaaaaataaataatgaggtgtctaagaacatatgccatgtttcatactgagtaaattttcaacaattactgtacttgtgatggcagaacccatacaggtgaatccttcatagattatgtgatgtagtatataatactaaaatagattcaaaattaccaggacaaaactactgagaatagtttatccctaagaatttcagctctgaagtctaagaccaggatgatgtccaggattcagttctaacaatgtattgtaaccagatcagatcaagacttgggtccagcttaaagatggacaccaaggaagggcttggtgtcaatggttttaagaaagaagcaacaatatatttcataccagcatatcaaacaaggtgaaatggtgagcgtgcttgaggagactcgtaccccgggctgatgaggtgcatgccagccatcccagccactgtctatgggcgcatctctggtctgaaagccagtccaaaagtatcccaaagggtcgccagctctggtctgatctggcagtccaagtgtcctattgaatcaggtacagcctaggctagaaatccatgcaagattgagcttaacgttgctgagcctaagttagcatagataggtctagtagagttcccaaaatatagtactccctccgttcccaaatacttgtcagcggacaccattcatatttaaactttgatcacttgtattttggaaaaaaaaattataaatactcaaaaagatgttgtgttatcaaattgtgttgcatcctaaacataaacattagctttcattcattataacctaaccagtcaatggtaacaaatagtacttgggaacagaggggtggtgaaggttctaatgcactcgggtaagctgttgagaatactacttccagcaaaaaggtgctagcaaaaatagtggtattagatttggtgggcacaaactctacagctaaccctgacctaactctcaatcaatcttttaaaacttttggcacagacataagttcttctcaatatgttttacaagggtttttttcaccctcttatgccaggggttgggctttggatcaagagctcaccctcatgcacaacatctctctgaacctatccaagtattcccagctgaatctttttcatcttctaaaagggccaaaaaaatggtgtttataaaacacaaaataagatgatatgatcgtctaaaggatggcaatgatcatatgttcacaatctttaaagataggatgcagaaagctcaatattcttctgttggactaataatagaaagacaccatcgtcttttctcaagaggtgcctcaagaatctagttcaaaggttctcgtagagtagatctagaccataaccacttcagccagtaatttaagcaagccaactggtatttgcaccgctcttgtagaacagcataagataagaaggaccatacaagtcttattaggcatttaatctggaatggtccattggccaaacactaaccaactagattaatagcaatcatagaatagctcaaatatgttcagtagatcttgtctttaacttcttcaatacaccaagcttattgggctaattttgtgttccagaacaaaatgtcagactttaccttcaagaaaaagggaaagaaaacactgtttgtagggagacaaatattagcatattatttagtaaccaaagacgtgattctagtagtttctaatactacttccgtcctttaatatatgacattgattatttcaaaattgaactaaccaacgtcatacataaaagaacagagggagtatcaattaggatagcaaaaataggctttcaaacccatatttcataagagtaaccgcttgcaactgtatatgcatagttacagatattaagatggaataaattactctgagtaaaatggaacaggtaaacctcttctcgcatatagcattgtatctctctaaaacagacttgcagtacattatgagtttatgaccaaatcatctcaccgattcaattttgtaaaatttaatgctctaattggatctaacgccaataaaacttatgcaaaaaatatttcatgtattgactgttcagttctagaattcccctatttccctcctatcaaaaacaagtcaatttttttcaattcaaagtcaacaaatgccgctttgaccactgaaattgtttacttgaaaagagattttaaaatgtagtttgattgaaatttttactcatatcttttcatttcatgcttcgaaaccatatattcaagacaatatattaaagtagaggcttaacaacaataatgcccacatcctgaaatggcatgaggtgcaatattcaaggtacaattttagggtagtcaagcaaaagtacatcactagtgatcagttgctgagaacatattagctttctaactgaattcgaactcttgaaagcagtgcatgtccaacatgctgaaactcacagatcaaagaaagcataagtgtgcgtgcgttgtgagtgtcagcattgtactgtgtaattctcaaaaaaaaaagcatatatttcatcagaaggcagcctaatgaaaagcacatactgaaatatcattgcattcggggtgctaattctttgttctgcatttttcactaacctgtataatcttttcagaacagactgttatttgccacaatcgcagtagagaataaatccttcagcacttcatttacattcacataagctatatggaatccaaagcactctttgattcttctgtcattgttgtccagtaagttcaccactaactctttgatgctgattgcttttgttctacagcagagattatatgtacgaacatcacaagtataagttggagaggagaatatttttttccctatataaatggacaaacatcagtacattgatgcaaataaggaagcacccaatacatgctgtttagctccacacaaatagttagaaaatgaatcattgtcttgtagtatcccacaaaaaactccaaactttccgcacatttgcagctagcaagttctcttcttttaccaaatctgcacagaagtctataaaatactccttccagttcatctaccaaaacaatccactctttgtccatgtagcttactttgccctgatctcctttgctggatatggatctctaaaggtcctcaagccacgagacaagtcaaatactctgaaagacttggacgtgctatttacttccgtatctgcatcaactgtttcaagcatggctactgttgaaatggaggatttctcaagcgctcaactctgggttttgactattttaatgctgattggtggtgaggtattcacttcaatgcttggcattcactttatgagagccgaatttggtacaaaagagtcagtcagcacaagggatcactcaccttgcattgatattgagtctattacttccacaaaatttggtcccagcacccagggcacaaaagttacagtttcattttctgaactccgcatggaaaatggaggacatgtagagcccaagacgattaaatttttaggttttgtagtgatgggatatcttctaataacaaacttaggcggctccctacttatttacctctaccttaacctggtaccaagtgcacataaaattctaaagagaaaaggcattgggatcatcgtattctcagtatttacagccatctcctcagttggaaattgtggcttcactccagtaaatgagaatatgattatctttcagaagaactccattcttctattgctaattcttcctcagatactagcaggaaatacattatttgcaccatgcttgagattaatggtgtggtcacttgagaagattaccggaaaaaaggattgtcgttacattcttgaatatccaaaggccattggatataaacatcttatgagtaccagggaaagtgtttatttgactttaacagttgtgagcttgatcattctgcaaaccgtattgttcctctctttggagtggagctcggtagctttggatggaatgagcaactatcaaaagatagtatccgctctatttcagtcggtcaatgctaggcatgcaggtgaatctgttacagatctgtcaaacctctcttcagcaatcctagtcctatacaccatcatgatgtaagtcccttctcaaaccttctccccaaaataagaatgatcataagtaagaaaacttcctgtatttattgctctagtcagtaaactatataatttaactaccttatcatggacatcacatttgccttccttcacttataatagccctatagtggttctctcgaatatgtgcagcaacgttcaaatatattgtacttcactaataggtaggttgcatatagtagaatggaacataaggacatcagataatctttaagaatacacaggaaagcttcctaccatagtactcctacctattaagaaaggaattttttaatcacacaatcccacaagccagactcagtgctagatttggttgaggactatagtagttcaagaaccacttacaggctcaacagtatattacatacaaagcagttagtccagtatatgttatcattgagaggaattgttcttaatatgtaatcttaacacatactttgactaatttttatgtaggtatctccctggttacacttcgtttttacccagacatgatggtgaggattctaagaccgagaagataaacaaaagaaaagggctattggagaactggatcttctcacatatgtcttatttggctatctttgtaatgctaatttgcatcacagaacgggactcgatggctacagatccacttaatttcaatgttttcagcatattgtttgaagtcgtcaggcaagccactgaaattcactgcattctgcagaaagctcatgattattttttaacatgagtatcatcactgaacatctggctctgattgttgcagtgcatatggaaatgtggggttctcggttggctacagctgcaagaggctactgaaccatgatgcacgctgcaaggatgcctcgtacgggtttgcggggaaatggagcgacaatgggaaagcgatcctgatcatcgtcatgcttttcgggaggcttaaaacgtttaacatgaagggtggaagagcctggaagcttagataacatctaaccaatttcagaataaaagtagctaaataatgctgaacagcttcaggtgtacacaacaatgtgctagcgacagattcgagcttagcttagaataacaagggtgattaggtgaaagatgctcgtcagcattatgtggcctttcattcaccaagaagccatgcatcttccacctgtgctaaaatgaactacaaaaaaaaaattgtattccagtttctttttgtgatagcctccatagttctctacaccaattccaacttccaattcatccagcaaaatattgggggttttttttttcgaacaacagcttcacgcattcagagaagaggagagaattcgaaacgactcgcacaaatccccaacatgactggatgcaacgaatcgaacgccaaatgcacatggacctagcttttcagatctgaagcaacggctaaggatgcagcagagcaatcgagtaggggaatgcattagtgaaggaggatgggttcacggagcgtacatacatctcgtcgggcggcgaagggaagctctcgcatggcggcggcggcgcgagccggcgacctcgatagcgagcgggcggtcgccgacgacggcgatgatggttcaggcagcctactgctagtgctacggttgggcacggcccaatcaatagggcccaattggcccggtttactttagccctcattaggatagtgagtcttttactgtgggttttggaattaatccttcctacacgtaaaacgagacatggattaatgtgtgattaattaagtacttcctccgtaaaaaaaactaacctaattggtgatttgacaccacctaaaacaatgaatctggacatggacatatggttgtccaagttcgtagtcctaggtaatgttaaaccctcatttaggttgcttttttttacggatagagtatgagttaaaaaacttaaaaataaattaatataatttttaaaatatagtatttttaatataaactttctagaaaacacattgtttagccgtttaaaaacatgtgccatcgcccaccaccttatttgattgcaatactgtagttttccactcgttgatggaggttctatctttgtagatgccatacgggcagtggggaacttgacgggtgcccccgcttcccgtacccgcatggggaggatgatggggaaatttgtcctttatttttaacataaactgttgttttgctctctcttattagggtttgtatttttgcctttattttttaaaaggaatcagtcgtttgcctccacctttgatgtctggttatatgggccccatggattttagttaaatctatatatatatatatatatatatagctaattaaaaaatacgtaaggtttccgggtgttttttttcgtacgtcattaccacgcgctacgctaaatccggatttaatccggttaacagcccgatcgggctttttttatctactccacaaccacgtttgatacggtatatatattttccatgtattcacttctcacatgtagtagtctgcccacttggtgagggatgaaagttttcatttcggccaccctggttcgactccactttcctctcatttttacacctattatccctttaaaataagtctactttgcctccctcatgtcaaattatatttgacttcgattttttttctctttttccaacagattttaatttattatgaaatcttatcttataatgaatcagtttttaattcgaaaattaaaaataattaaattatgtacacaaaaatcaatataaatatacgtttacctaggccctagaataagtctactttccctccctctgtcaaatcatatttgcgcgtaattttttttctctcaaccaatagcacggaccatgcacatccgatgaataaaaaatcaaaagttctgcacctctttcttcaacagacttttagtgattctgaaatcttataattatattatataaaaaaaatcagtataaacacgtgaaccaaccgatattttttaaaaacatgaaaattgaatatgtgcatggtgtgaaacttcacaccatggctccgttccttctatctcggtttttgttagcgcgtttttaaaactttctatatacaattgatataaaatactagatattttttcttaatttttgtaataataaaactcaattaatcatgcactaagaggttttctacaaaagaaaaaggaacggcatggtacggctggcgctgttcaggttttgccggttagagcatagcagtgtactgttgcattgtgattataaatcaatgcaatgttatagcaattatcaattatgaaaaaagaatataaaagtgtcataaaaaatgtagtttaaaataattaatgaactcccaaaaaattcattttgtacttatacgtaaaggtgcgttgctcagacgtccatttctccaatgctacaatcatcgggaccatgtgttagggacatcattcacatcctacacgcgtagagcggattaattgtccaagcacaaatatgcatttgtgataactatgaaggtgcttcgataaatcattgaggttaaatttcattcacctaaccattacccagtgcaatgatatcacagtttgtcacacaagggttgagagagagtgtgtgtttttttatccatcctgattatcattagcctaataaataatttatctatcatgaaacattactatatacatgttaactctagactttatagcatctaactgttcctttgcccgtaacaaagcatgtgtatttttctagcataacagtaacatgattaaaatatccttcacccgttgcaacgctcgggcatttttaaaatactccctccattttaaaatgtttgacaccgttgactttttagtacgtgtttgaccattcgtcttattcaaaaaatttaagtaattatttatccttttcatatcatttgatttattgttaaatatactttcatgtacacgaatggtcaaacatgtgctaaaaagttaacggtgtcaaacattttgaaacggagggagtatgagaaaatgatttatgaaatattgattcattgttatccctgagtaaatggatagagttccaagcaccatcgaatctcgtacttgtagtccgtcaccacccaaaaaccttagaggaggcagcggccaggcgcgtggaggcctgcgacaatcgtgaggcttcctacgcctagtgcggtgagcggcggtaaggcacgccatggtaggtggtgactgtggggcttgttgcggtgagcggcgggtgaaagggtcatgggattgcttctatgcgatctagggaaagggcaaagttgcacgggttgaaaaatatagggtcaaaatacaacaacaatcgagaatataaatgttctttcgcgctagagttaacaccgtcaaacctaccgtcacccgtgagggcaaacaactaaggggtatttagataccggggtataaagttttggcgtgtcacatcgagtattatatagagtctcgcatagggtgttcggacactaataaaaaaactaattacaaaattaatcagtaaaccacaagacgaatttattaagtataattaatccgtcattagcaaatatttactatagcaccatattgtcaaatcatggagcaattagacttaaaaaatttgtttcgcgaattagtcgcaatctatacaattagttattttttaagcatatatttaatactttatgcgtgtgttaaacattcgatgtcacatgataaaaaaatttgagtgatctaaacagggcctaattcatttttcaaaaaaaacaaggacaaaatgcaaaccctaaaacgcgaaagaaaacaatagttcggggttaaaagtgaccaaaaatttgcacccgagtgctgtgtgactgaggacatatcacatgtgaggtgcaaaaacgtgtggccacagaagatcacgggcagctgacgtggtgcgccgtcacgttgccgccggtggtcggtggtgcggatccgagtcggctcccatcactgggccggcgccgccattttcccaaactacccccgacgccgcaacgcatttcgcggcggcttccaaagcagtatcgtaaatacgtaggggaatgaggggcaaaagggagctgctttccttcctcgcagcgatcaacacaaaaagcttctctttcccttctcctcctcggtgatctgtctcgccggggcatctcgaaaagcatccgactccgacgccgccgcgcgccaccacccggccgatcgccgacgccgcagccgctggaagcagcagggacgacggagaatcggagatggacatcgaggcgttcatccacggcggaagcgggggcggcgacgccgacgccgaccacccgctcggcatcttctccgccgccgacctctccggcttcggcttcgcggactcggtgagtgattgattactgattattatgctgcctgctgcgactacgtagtatagtagtagtagtagggtgtgttttcacgccaaaattgaaagtttggttgaaattaaaacgatgtgacggaaaaattagaagtttgtgtgtgtaggaaagttttgatacgatggaaaagttgaaagtttgaagataaaatttggatctaaactgggccgtagtattaaattcgtgtgctaaaattaagttgaacacttgctgtattggatagcttgcagtagcacgtacggtgcttgtatatgcgtttttttagaaacgtgcttgtatatgcttgactagagtttcatgtctgcgaaattttcgttaattgctgctgatcagctgactcctactacctttctcaagtagaagactgttggttcatcctctaccatttttttacttgtacagtaatttttcatagttggtacgcaagtactccctccgacctccaatccaatatactcatatacttacgtgcaacttaatgcgacatatcctaatactatgaatatggatagacagtaataaatttactcttactaggagttttttttccccgattatatggaagacacacatcacaacacaagcacaccaaacttgcacaattttagttcgcgaacgaatgatgtcttgtgttttaaaagaatttatttgaatagcccgataagaggaaatcatgaattctaaagcatggaagaggagaaaccattttaggttaacagcataacatgagagtttccgttgtcatgacagggtttgattaagttggtattaaggactggtgataagtaattcttttcatataaggaagatgattacaagccctggttgcttatcttaaatcgtacttgattcttgatttgcatgattgatcactcgattaattttacttatatttttgtccaagcagagcaccatcacagggggcattcccaatcacatatggccccagtcccagaacctgaacgcacggcatcctgcggtctccacgacaattgagtcgcagtcatcaatctgtggtacggcctcacactcgtcatcttccacgattttcatcaattattcataagactgcaacaatttgcacacaaaaatacttgttgttcgatgtactcaatgatttgctactgtattgcacactgaaaagcacatgcaacttggatttttcaactcatggagatttcagcgatggacatccatggacagtaccagtgctgttactgtgtcatgtactgcatcaaaattgtgtttattgatgaggcacaaacaatgttcagtttatttaattgttcttgctcactctctgttcaattttctgtaatcagcagcagcaagtcccacatcagctaccaatctgaacatgaaggagagccaaactctgggaggcacaagtggttcggattctgaaagtgaatcgctgttggatatagagggtggtccatgcgaacaaagcacgaacccgttggacgtgaagagagtgagaaggtattccaagaacataagcgactatgtcaagcattttgtctgtcactgcgtgaaaaattatgggcatattcgctagtagtagaagttgaacattgcttttcagaaggaatgtttgacaaagaacttgcatgaaacggttgggggcttcaaattacaggatggtgtccaatcgggagtctgctcggcgatcgaggaagagaaagcaagctcacttagctgatctcgagtcacaggtaaactgatatgatctgaagttttgtacctgccgaacatttgccattgttcaattcaaacagtaacagattgattcgactaacaaatcatgtgccaattggtagctgtaattctgagtcaaaatgcgaaatgctagtgccggttctttcagatttccatagctcaaatcatgctcttgtttgtcaggttgaccagctccggggcgaaaacgcatcgcttttcaagcagttgacggatgccaaccagcaattcacaacttctgtcacggacaacagaatcctcaaatcagacgttgaggccctccgggtcaaggtgatcattcatctccatcttcatctgcacattgcattgctcatcactgtagccatcgtcaaatccgtcctgcattttcggccggtttctgagctctgaattcgtccccgtttgtaagtgcaggtgaagatggcggaggacatggtggcgcggggggcgctgtcgtgcgggctcggccacctgggcgggctgtcgccggcgctgaacccccggcaggcgtgccgcgtccccgacgtgctcgccggcctggactacgccggcgacgaccccttcacggccgggctgtcccagccggagcagttgcagatgcccggcggcgaggtggttgacgcctggggctgggacaaccaccccaacggcggcatgtccaagtgaaactactggtcctacttctatgtcagctcagctacgtttgaaacgtgatgtgtccaagtgaacggacttgagtttttcagagtcctcgtgtcgaagtgtcatgcactcttccctattcctgtaatagaactgactagctaagagactgaaagtctgaaactacgaagtataaatgtggtggaatttggaactatttttttctgatctggttgagcttgccttctgaattcatgatccatcattggtgagagcctggagaattcaggtaagtgaccaaatggtcgaaaaaatttcatctggtagggatatggtaaatcagatttactctgaaagtgaatgcttcgtttctgaacaattcatggtgataaataattgagtgcgatttctatgcttcaaaggactctaataatgatctgtgaatggttaaggacgatttaatttacaattacaatggtttggttcagttttgattttgctcttcgtcccttcccgccatctccctcgcgcgctccctctcttccatctccaccaccagctcgccgtacgcggcggaggccaagccgccggcctccgccgtggccgccagcgccgccgcgaggccgacgcagatcctcttcttcccctcctcctcgttccactcctcctcgccgccgcgccgccgcgcggccgtggcgacggcggccgcctcggcggcgagggcatccacggccctggtggccgcctcgacgtcgacggcctcgaccgcggcggcccacgcggcgaggaggcgcggcatgtgctcgccgtccgcgacgcagctccgggcccacccccagagcgccgccgcgtagccgcgctgcgactccgcccacgcctccatcgccgcgccccacccgcggagctccgccccgagcgcgcccgccgccgtggccgcccgcgcctgccccggcggcggcggcgggcccctgacgcctccctcgccgcccgcagccgcgcgcgccgccgccgccgacgacgacgagaggagcgcgcacgcctcgtccgccgtgcgcttcatcacccggtgcgcatcggcgatcaccatccacatcctcgccaacctaaaacatctcaaacaaattaacaaaaaaaagaggaaaaaacatctcagaagatcagatcgatggatggattggcattgttcttgccctcggatgagctgggcgagctgggggaggagctcgtcgtcgcggacggcggcgatccgcttggagacggcgtcgacggaggtgatggagatgtcgagcttggtgcggaggtctctcatggcggccctggtcctctcgatggcggacggctcggcgccattggcgtcctggctccgcagcagcgcgcacttcctctcgtacgacagcctcacccgctcccctgccttcaccaccaccgccatggaaaacgaaatgaaaagctcggagctacacgaagacgatgacgtcagagtttggaagatatcggggtctctaccttgacttcctcgtagagcctcttctcccactcgtagagcctatcgaggctctccttgtggctcttgaagagctcgaatggctccggcgagacctcgccgccgccttcctcgtcatcaccgtcgctcggagcagctggtcggactgtctacaagacatcaatgatcaatgatggagaagaagaagaggaaggaatggattctaatatttcttctctgttaattaaatggttattttttaaaaaaataacaaaatatatttatatgtaatatatcacttatataagcttaaatttaacttttacaagttataaaaaaataacaaattgagtatacctatatttatataggggacatattcggtcaaaactatcaaataagtaaaacccgtggaaaccatatttaaaagttttataaattcatgaaaaaattactagagattggtacaggaatgaaatacattcataccaaatctcaagtccaaactcaacttcatttgagagaaaaaaaagacaaatttcgtgtgaatagtaacataacagtattcacccgaaatttgtgatatttggtatgaatgtaattcatgcatgtccctatctctagtaattttttcatgaatttacaaaaatttagatatggttttcacaggttttcatttatttgatggttttcacttgatatttctctatttatatataactatatttgcagtttaatttgttatttttgttataactcgtaaaagttgaattttaacttgtatatttgtaaagtgtaatacatcaatctattttgttaaaatttttagaattattctataactatttagtttagatgcgagacattgttcatcgagtacttaaaaaccttcctgaagaggaagacattgtttgcgagagattaactacaagaggctgtaatggcgtgcgtgtacctttcctctggtaggggacgacctcgaggaggacggagacgtggttggcggtgtcgacgatcttcacgaagtggccctggatgtccctcatggcctccgccatgctcgccggtggccggtccacgtacacggtgaaccccggcgtgctctgctgctcgatctcctcgctcgccacaaccctcagttcgttcttcacgcgatccaccgtcttctcttcctcctcctcctccgccatcggccgctccacagccgccggcgaagcttccgcctgcagcttgacatcgccgtcgccgtcgtcgtcgtcggcggcgtcgtcgctttcttcttccagctccggcatctgctcgtcatcttcgtcatcgcttctcctcctcctctcttcgtcatcttcaacgccatagctcacgtattgttggtgatcgtgatggagcgaggagaaagggtcccaagagacgaagtcccatgtcgttgtcggctgcggcggcggcggcgaggccggcatggcattcaccggagcgtacgacgaagggtggaagagctggccgggatccgcgccgaagaacccgtccaccgtgacggtctcggcggcaacatcattctcctcccaccgctgctccacctccaccaccgggtgcaccggcgcgccgccgccgacgccgccggcgtctggtctcagccagttcatgacaagaaccttcctctccggcgagcacggccggtgccggcacggcgccgccgacgacgccgccgtgtcctggaggaagtagaggtgctcgtcctcggcgaggcagtagaagagggcgagcgagacgcggcggagggagtgggcgtaggcgacatgggaggaggcgagcaggttcctctgcgcgatcgccttcttcacgaagctcctccggtcatggcacgtcttcacggccgcctcctcctccaccttcttcgacgacgagcaccccatttttaatttgatcttcgaaattcagatgaaccggggtgctttttatccatatgtgtgatgaacacgaatcagataggggatatatatatatatatatatatatatatatatatatatatatctgtgtgtgtgtgtgtgtgtgtgtggtctctgcaaggaaagaacatttaatttcttggatgaggtaactgaaggtgcttgcttataccaagggatccttttgtggctttgcaagatgaacaaaggcagtggtgattcatattattctgaacttctgttgtaagttagggaaaaactaatgaaattgaagttcgcaaaggatcttgcacaaggaagaaatggatacgaccgagacaggtaaaaaggtctcgatgcatggaggagagtctaccattgacccactttaactcaattaaaaataaaaaacaattcatactgaggcatttaccatttaggctgaatgtttgtgcaggtaatcgaacttgcaagtatttactctgatgcctgaactacgaagagtattactcgttccgccgttccgttttaggttataagtctgctttaagtttggttaagtttgtagaaaaaaatagtaacatttttaacctaagacaaatttatatgaaaatatattcgataactgatttgataaaactaatttagtattgtaaatattactatattagtctataaattttgtcaaacttaaattagtttgactttaatcagagttaaaatgacttataacctgaaatagatggagtagctagcaatcaataatattttatgtgtggtattaatgttagaatataacgaaaatgccaaccgcggagctcggacgactacccgaccagctcgggagctagctccgacgctgctaaaaggttgagtttaaatgttcgtttgaacaaggtaatttgcgacgactgaataaacttgatagtttatgctgcccttcttaatttattcatcggattattgaaatagattatttgctccacactttaaaaatatggttgctcaaaattcttttcttctttattatttacataacttctttttaaaaatattaacatttttttaaaaaaattaatttatccctataatcaaatagataatccgtataaataatctaaatcaaacgggccggtagcatattgactaacaaacaacaagttatctgaatttaaagcatcagtttgaataaaaaaagttgtgtgtacaaaagatgcatggtggaatataatgcacctaatgccaaatctgaaataccaaatccacgttagctgccgaaacttatatctccacctgaaattcaatcccctctaaaggagaaaagtggatttaactgcatttttgttgtcatatatggttttatttttttgtacaaatttgaatagttttacatggattttctaattttgcatgaattgtgagtttgtcctgtttaggttagaacaattcattgttcaaccatttatctttgaaagaatgggctttgttcaaggggttaggtaacagcggagagatgtgatacctatgaaaagcaaacggaaaattttaaattccgggcggttaataaatctagacactccctaaatactatataggggaaggcatgaatattttttcatcaattgtaattagaacgtatattgattggtaaaatttgacattttagttttttttttgcgaggaaacagggatcactttattcaatcaaagcatcgacacaaactagttgtgcgatagcattacagctattgtctggccagaagtgagtaagttcctccactcggcctttattagctaaaacatgactaatacggttttgattcctatgcaccttagcaagactaacaaccctgtttcccatcatgaggtcgtgcacctccttgactaaaaacatcaactccgatcggaccaactccttggactggagcaaattcagcatctcctggcaatcagtttctatgatgatcggtagcagtgtccattggagagccataagtaatccctcccgacacgccatcagttccgcttctagagcacctgtgcaccgttggatgtaaccacaagctgcaaagatgacttctcctagtctatttcggagcaccacacccaggccgcctttccctgtatcaggttgaaaagaaccatcaatgttcaacttcatcagtccctgatctggcggcttccatccgtgcagaacatcatcttggggattgactgtcctatgcactttcttcaccttcgcacaaaccacatgtttgcctttaaccagattcgcttcaggtttcttcagacattttagtatttgaccctaacatgttttatatttatggaaatataaactataagatttatatatatcatatttagcaatacttttaatgaacatattgtatgctaattacaaatgtatttacggaacagaaactaacatttggacatcacaacagattatattctgaatacttacaactatgtgtctatgacaacttcagagttgtatatcaaattcaattcaatttattttaaaaaattgcttcacacaatattatacaggaaaaaaccgctactacttactaacctgacatgtaaaaactcatctaatagtatcactgttattgtaaatcaagattacaagctcttatgagcatctccagcagggaccttaaacccagtccctaaacaaattttgagggttaacataaaaaaactagatccagcagagaccctaaacccagcccccaaaatgaggaggccctcagatccacccccaagcccctagtcctggggctccgagcacagcccccattgacatttttctggtcccaaacgacaattcactttcgtgctctcatcacattcctgcgcggcaccgcgacgctggatctcatctgggctccagcgccggcggccatcgattcccctgcacctccggcaagattggcacaaaaaggtgagaatttcccctacctctgtcgcccatcatccgcaagggtctccggccgccgccctcacgagtccgccgtccacatggtgtcgcacgacctcccgccgtcggtctgcacgttgctatccacacaccaccccgcacagccatggtcctcccgctgcagagccatcgtccctaccgctgtccacccgtatgccgctatccgctcgccggcaggagagccaacggctgcccgcccccacgctgccccattggcccaccggatggagggccgccgcctgcgcactgccggagggccactactccaagccagcccacacgccgccctctgctcgccgccctttgccccctagagttttctggattgatctaatctgtgtggtaggagtactactagcagagaagtagtagtattatacttgaccactttttgtgctggatattgatttgttttatatattttttagaactgtaggagtagtagacttcttcggtggtagagaagaatctcaaacactgtgcttgtactagtagcactgcactgaactgtcgttgctatggatcagtagagttatcggttagtatgtagcacttctttttataggctttgattattatgaatataattgtctagtttgttatttgagatagtggaaattaaattttcttatggaacatttgtgggcgcttcatggtgctcgatagtttgtttcgttgcattttttgtcaactatgggtcgtgttcaatattttcttgtaggacatgtcattctcatgttaaaaaatttgaattcaaatttgaatcatggtgtttaaaattgtaaatttcaatatggttgaatttcatgcgctagaattatttatgtttaaattattatggtgttaaggtagacacaaacatacaatttatactaaaataaaagagaaaaagaaataggggctaaaatatagggggctactgctagagttaatgctatttttagagtcataaagaattggtggcagcccccatttgatctttaggagctctaaagtaggggttactgctggagatgttcttagatgtcttttcacatctcgaaaggccacaatgctgtgcacttaaaaaaggccacagattctatgacccaccggcccacatgtcagcgtcctaaaccaacacgagacgcagcgctcgcaaccgtatcagaaaagaagaggcgtcctccaatcagagctcgagacgaacccaattactagcagcaccaaaatataatcagatccgaaacaaaaagaaaaacaaaaaaaaacacgacgacatctatttaaggcaggatccacctcacccccgccccgcccaaatcgctccctccccttccctccccgaccagatcgcgacaccgccaccgccgatccgaaggtcggcgacgacgaccaccaccgccgccgccctcgtcctcgccgccggcggccatggcgttcggcgaccgcatcaccaccttcgaggactccgagaaggagagcgagtacggctacgtccgcaaggtccgtcaccccccctcctccccccctctccgctatactcctctgctcgcattgcttccaatgtagatcccaccgtgctcgttccgcgcgatcccgacggggcgcgggctctgtggcggcgggggcgtggtcggatcggggctgaattggcgccgagatttggttaggatgggatggggtggtggtggtgatggcgcggattgctttggggatctgtcgcgggcgggtggctagatagggccttcggatccagtctggcattggtggctagctcgcttggtcgggtggggttttgcggagagtccgtgttgctgcgcggctctgcttgagattcgcatgtggtgtggtgttctgatcgccagtccgtaccacgccatcatataatgatatgatcttttgttgcaggggtatcgctaatagtttaggttttactgtgaactcgtgactagagcggtgctcagatgtgttttgacaatttgactgatggatggcattgctattagcgtggttggatgtaaaaataaagttgttcgtttgttgtaatttaagaaccactagaagatacactggcttctattcctctcccggattatggattgaatgatgaaccctggacgaatagtgtgcactctcactctctgcttaatttcatcgaatttgctactccccttgttctaaaatataacaacctagtacaagatttggcatcacctagtaggagatctgtctagaatcgcagtactcggtgttatattttgggatggatggagtatctatttagaaacaatacacatcattccaaaaatgccatagttcaactgaccgtgccactcaacaatgaattgcgtcactcatgtatttctagataggtttatgctagatttagtgtttgttaatgctaaactgagttttctcatacttatgtgttggaatcgtagatcctattatgaactcagtgctatcgtatctgtctggtagaatatttagatgtcatcttatgctaagatctgcttcctagttatatgcgcactagtaattgccctttttcttttgtatgatggcatgtttagctcttaatttcattgtgttgatgaacattattgatcgaatgggttgttttaggtctctggacctgtggttgtggctgatggaatgggaggtgctgccatgtatgaactcgtccgtgttgggcacgataatcttattggagaaattattcgtcttgagggggattcagctacaattcaaggtgtggaacagctctttagtttctatctttaacagcatacagacacgagttctgatagcaattatatgcctgttgaaaccatagtcaatatctaacatcagaaatgttgttatttgtgtatcacagtttatgaggaaactgctggactgatggttaacgaccctgttttgagaacacgaaaggtgcttttttgtcatttattaaactgatctgtcaagcgtacttgtttttgcttgtttttaacacataaaggttatgcctgcacagcccctgtcggttgagttgggacctggtattcttgggaacatttttgatgggatccaggtacttcaagttgtgaatgtggagtaatttcatttattttttaagctccttgcactccttgtctgttaactcttgtcatgtcctttttcctatcgtgtttgcagcgccctctgaaaactattgctattaaatctggagatgtgtacattccgcgtggtgtctcagttcctgcccttgacaaagatgctttgtggcattttaagccagaaaaactaggtaaagtattttgtatacttcaggggggaggggggggggttaccttttgttatcctttttcatttagcatgcagtgcaaggcactctaaaatcatctcctattatcattatgctgcaggtgttggagatattatcacgggtggagatctatatgctgtaagttaccatgaattttgagtttcgtcttatatggttatcatgaacactatgcatcaagatagtagcttgagatctgtcatcattaatcatgtgcctttgctaaagttttctgactatatggcagattgtcaatgaaaatactttgatgcaacacaaggttgctcttccacctggcgctatggggaaaataagttacatcgccccagctggtcaatatagcctgcaggttagtggatgctatcagtatcactttatcccatgtcctattgatctgcatgcattctaactttgcttaaccttgtatggaaccctgcttttgctataaatgcaggatacagtgctagaattggaatttcagggtatcaaaaaggaatttaccatgctccaggtaaacaagttccatcttttatgaagataacatgtctgaggattaaagcattagtttaatctgttgtactgcactacagacatggcctgtgcgttcaccaaggcctgttatggaaaaacttgctgcagatacacctcttcttacaggacaggtttgtacagaacctaccatggttctcactcataataatatgtgcttttcctccccatttttattaaggtttctgtgttgaaccactaaatgctcaaagtactgttttccccctcttttttctactcaactaatctaattcttatatacttttaaacgatcccagcgtgtacttgatgcattgttcccctcagttcttggaggaacatgtgccattcctggagcttttggttgtggaaagactgtcattagtcaggcactttccaaggtgatcactatttttctattcctcattgccatgtagtatctatagaaactatactctctttttgttgccttgatcacatctttgtactgagatgaatagcctctcaaactctgcagtattccaactcccaagctgtggtttatgtcggatgtggcgaaagaggaaatgagatggctgaggttctcatggactttccccaattgacaatgacgacagaggatggacgtgaagagtctgtgatgaagagaacaacactggtggctaacacatccaacatgcctgtcgctgctcgtgaagcttccatttatacaggtaatggtgtattgctcctgattgattgctacattaagccataatagtgtctgatatccatatagtgtgccccactttgtcatatagtagttgttttgttttttagttgtcatatagttgtttagttttgtatggatcccagcaatatgatgttacatcaacctggacatgcctacttatttggtacgagtactagttaacatgtatccacgtttagaatcttcacaccgcacaacagtggctgaaagtacaacattgatgatatatgcatctttgtccctggtttatctgtgtataagagatgcagggcaaaatgaaatgtagatgcgcatttattcctgagacccacacttgtatattattgtgaaatatattataaaatcttgatgatgaaggcatttccctccccaactatattttcaattgttgctatccagttagattttttgtaacattggcttatctatatgtttaatttcctgttgctttggtcatttggactgctatatgtattttatggaccttaagttcatcaccaatgatctcattgtaaacaaaatcttatatgactttgccccccaggaattacgatagctgagtattaccgtgacatgggttacaatgtcagcatgatggctgattccacctcacgatgggctgaggcattgcgtgaaatttctgggcgtttggtacgttgtttttcttctgccatacttgccctcatttcctttttgtatttctcatcctagtgtactttaacttgcacaaagctctgtcctattctcattggaaagacaatcagcttccgatttcttaaacggtgtgccgacatatttacactagcagttattctttcattgtgttttcactagtagttatgatagcctatttacactaaagtagttatagaatcaatttacatcatttactgcaatattaccatgtatggctaaaaattgctaactgctaatatagcctttggaaatagaatacttaaaagttaagattgttataactcattcgtgttgattttttgaatatctattttatgttaatattctaatgggcaatgccacatttttgttatccaggctgaaatgcctgcagatagtggttaccctgcttatttggctgcaagactggcatctttctatgaacgtgctggtaaagtaaggtgtcttggaagtccaaaacgggacggaagtgttacaattgtaggggctgtctctccacctggtggtgatttttcagatcctgttacctctgcaacccttagtattgttcaggtaaggaagcagctaagtctgtcatgattaataatgtttatcgtttcagtgttgttaaaccacatgttcttgtttgtaggtcttctggggattagataaaaagcttgcccagaggaagcatttcccatcagtgaattggctcatatcttattcgaaatattctaaggtttgttctgacaagcaacttgcttaaatagtttattctcccctcagattccaactgtaagttgatttagacttgtgcacaaagattaagaaagtactaaaatgaatttgttgccattcatttattttcatgaaaatgcaagagaattgcgtttcatttcattaaggggaagaaaataaagtaattttttttgttgccattcatttatagttttatactattgaaaaaatggaacatttatttgtgagagctgtagcacttattttatttgacaagggcaaacatgaaagagttcactataagttgtttttacttttttctagtcaaacttaaaagtttgtagaaaaatatagcaacattttcaacacaaaacaaacatagtatcaaaatatattcaatgttacatttgattaaactaatttgatgttgtaacttgtaaatgttgctaattttttctataaacttggtcaaatgtaaagaaatttgactaggaaaaatgtcaaagcgacaaaatataaaacggagagaataggaaggagttgagtggccagaggaagtagacaacaggtctctagaataacagaactatacgagtttctatggttataatttgttctaattgtttttggtcttctaactcatttttttcaatgaaatgctaataagtttatatttgaacattttcctgttcgttcgcatttgctttgatgttatgtgacaatacaatgttttgtgttgcaggcgcttgagccgcactatgagagggaagatccagatttcattgatattagaacaaaggcacgtgaggtgttgcagagggaagatgatttaaatgaaatagtgcaggtactattttgagccttgtgaatatttactctcctggaattccacgatggtttgacctgtcttattgaagttaccttttctcatactgtcgtatccctcctggctgtaatgcttcttattaatctgcatcatgcaaatgtaacatcctatcagaagtgttcgcacatattacttgcctaccataagtgctttgtaccagtttcttggcatttgttcacttaatggtcctgctaatattttgaaaatgataataaacttgaccttagtacgtacgttatttttaaacaagctgtggcataagtaagatttgagcttttgttgttctttgtgtgatatttattgttgactctaccccacattcagcttgttggtaaagacgcactggcagaatctgacaagattacactggagacagcaaaacttctgagagaagattatttggcacaaaatgcattcaccccgtgagtgttaaacccatttgatagttctactaacctgtgtcataatccatattaactaattgatcaattctgttgcatgaaacagatatgataagtattgcccattctacaaatctgtttggatgatgcgcaacattattcatttcaacacattggcaacccaggtaaattctcttgttccaggaattcgataatttgccaattttctttagaaaaccaatcctagctgactagaaaatcatgccaaaactttccaataattgtgttctatcagctgtcactgatgctcgtgagcttatatttaaatcaatctgggtcacctagaggccccaaatcccaagatcatagagtggcgtgaaactgagacactggttcctgtttgatctagaatttctgatttctggaacaaaaagatagtagtatgagttggatttatatacggagttctaggttttggattactggcatagataggctctggatcgatttgtcacttgaatttaaataattgaatcctagcatgggcatcagcatggaacttcaacacttaaggtatcatttacattgaaaggtgaatgagtggagctaattgaagacaactgaactgattagaggcactgtttgttgtatgtcatataagttactcattgtttactcattactcaatataattacaaataggatattcccatacaaaagtagcataagtactattttaataatctgtatgcttttattgttttataggcggtggagcgggcagctggtgctgatggacagaagattacatacagtgtcataaagcatcgcatgggcgatctattctaccgcctagtgtacgcatttctaccctattttcaagtttctaacactcgctgtgtagattgcaatatgaccaatggtatttgttgcttgtcacaggtcgcaaaaattcgaggatcccgcagagggcaaagaagttttgattgcgaaatttcagaagctgtacgatgaccttaccgccgggttccgcaatctagaagacgaagcacggtgaataattattgtagattctgtgtaaacaataaggatatatcaccaaatgttctataaaaaaaacatggaagcattccatttgctgctaccgaggctctaggtcgagatcatgtagaaattttcctgcaactatacgcgccgtcgtcgttttgtcaggttttgatcccaagtgctcgatggacacgccattatttctactctatgtatcatttatttatcatcttcattcacatcattgtaataaacatgggcatgtttatagtcgaataaatacgatgtccatctgtttaaaagtcttcgttgaaggtcattcatctttatttgttcgttgaaaagcaaatgttgcttagttttaggtatctggctgtggcagtttatgatgtggtacgatgagcaggtaagagatatgtaattaactttttgagtactctttttttctttattgtacgattgaaacttataggccagaagtatgagttagtcacaccaactaaatgcatttagacctttgtttctgtatgtcaaattggaaggctggaattacgcagccaggttattaacacaaaactcatgtggtaggcagattaagccaatccacgctaataaatattgatgctgactcgcaaaacaatcaaaatcatgctaatttttgctgttttattgccattattgaatcccttttgcactatgctggaactggaagatgctgaagctggagagtggctagacaaagctatgtccagtacagatacagtgcacattggcatattactgtgtttcttgtctggaacgcagcagcctgtacttatttgactcgatccatgtgaatggtttccacagaaattccaagctttattaacatttggggccaatcaataatgtccaactcaaatcaacggatcaaccttataatattttaatatattattacattgtgatccctgttgtaagtgtgtgcagagttttaaatttgtcaatgttgtcttctcctaaactcctacttgtttggctggattctccttttgcaatatactttatttatttcaacctaaaattctcccttttctttgttggttatattctatttccaaaacagaacaaaacaatgttgtttctgacgtgtacaactcctacagattagcgataaaacgagtgttgttttgacttttgacactttgagcatgagtatattagagttggtttctctattaattaagttctaagttaacatccggtgtagtgtttcaaatcatacgatgatccatcgtccacggcaaggcatgcatatgcctgaaattgaacagtccaaaacagaggtcaataaccgcagcttcgtgggggcacgacaagtctgtgaaatattctaagggcaaaaacaatgagcctagcattatcatttattgaggacaatttgagcataaaaatgttatccactattggagacacatagaataaaaaaagagaggcaaatttggcaaaactgcatttaatagtaactagttcatggtagagtgaaatattcccgcaatgcctcgtttgttcacaatatttatccgcggtacaatgtgtacataaaatttgggcaattaatacatgatgtactttacccgcacaaagtattcaattagatatatagagagataacacttcgataaaccaaaaactccgaggatttgccaatccgttctaccattaattaatcctttcatatgcgtatgacgtgggttttggtcgcgtgttattataaacaacaaatgctagatttcatcttcaactactactacgtacaagggagagtggaatgtcaaatcataaaaatccctgcaataaccacattctcctatgttgttttgtgcacaaacacaatggatcaatattgccatgtgaaagaatatctgggcagtcaataaaaaaaatgtatacactactatagcacatcagatgatctgaccaagaggagaagaagaagagagaggatcccaaccccaccacctctcctcctcctcctctctctctctccgatctgcctcgccgccgccgcggctgctcttctcctctcgcctcgcctcgtgcgcgcggcgagttcgacctcctcctcctcctctccgagcccccgcctcccctggctgcgggcggggggtttcgagggggtggacgcggcctccgtgtcggcttcggctcggatcgaattcaaaggtatcgctcgagctctcgctgctcttacggcggcgcttgatgagcaccgcggcgtagattgtgagatccatcgggagttgggattgatttccttccttttccaatcagtttaccccggatttattttattaatttgatgatacgtgatggtttagtattattgatagcagtttgtttccaatattgattcgacgagggttctgctcaaccctatattccccacgttaggtccggctccttgcgccggtattcacagctaattgtattatgacacttagagtgtgatttgtggattaatactttgttgagtgtgattggtggattaatacaatgaataaccttgcatttgcagaagaggttggaaaccttggtggtgtagttagtgccaccgcccctgtctggagtggcatgtagttttcgcaaggctttgtttatgattttgtcgatggcgaggagatgaaggcatcgcaggtgtggcaacggggcagcaaggacatgacagccatgccccctccgcgccaacgaggcgccgccaagaagcccatgtggataatcgtgctgctgtcgctggtgtgcgtcgcgctcatcggggcctacgcgtaccctccgcgccgctactccgcgtgctacttcttcgcttcgagcgtctgcactcctttcaaggattggctccctactgtgacccgacgggagcgaacagacgaagagatcgtctcgtctgttgttatgagggatctccttgcaatgcccatgcctgtctcgaagaatccaaagattgccttgatgttcttaacaccaggttcattgccctttgagaaactatgggagaaatttctacaggtgtggcgcagatatacccatcatgtgcttctttctgtaatgaggatggagtttgtactatgtatagatgcatcaacatctagtttgtaaaatttatttgcttgaacttctgtgtgcagggtcatgaggatcgatattccatttatatccatgcatcgcgtgaaagacctgtacattctagttctttgtttgttggccgagagattcatagtgaaaaggtactaatgttcacccccacactgtgtacttgtttgtttcttttcttgctttatcttaactcatctgcttagcaaggtgttatgaacaataagaaatgttgttatgcattgacaactgttccttttgtttatactaagaaagaagaaaattgtgttattgcttggattagttttcgatgactataagtgagattacatttgcaaccaatgacctgcatataaggcaagcttttaacaaagaaactctatgttgttaaaataaagaaaaagaaatatctaaattcaaaaagaagaagatttgagcctaggtggtggtagtgtacacaacccacacccatcagatgagctaggcttagttcacttttttttttaatctggcttgtacttcctgtgtttaggaaattccatgttggttctcctaagaagttcttactttttagtagtacattttgcagcaaataagcaaaaggactgtgatttgtcttttgaaatttttgctatcagtgattcctgtgatttcttttacatccaacatagtattttataatttgttttgcagaactaaagcattgcattgtctttgtatgtgcaggttgtatgggggaggatttcaatggttgatgcggagaagaggctgctagcaaatgcattggaagatgttgataatcaatttttcgtcttgctatcggacaggttttgtttttaaaaaactttgcctgcaaaaagaaaatgtttttgttgcactttgttaagatcctttttatttgtttgacagctgtgttccactacatacatttgattacatatataattttttgatgggaacaaacgtcagcttcattgattggtaagagcgctgaactcatattttgatccatttgacaagaggaaaatatagtacatacaagtgcaggaaatagctactttcagagcatgtaattctgctttaaaaaagttctttggtatattgattataacatttctactttaatttcatctgtgacctagagaataactgggaatatgaaaatcaggaatatttcatcatgcattttattctagatcaatcttttggcttatatttctttacaaaggaatacccttgttacatcacaagaatggtgtagaaaacgttggtgtgttttgacttaaagaatggaatgcattaacacagagctatgatcaccgcacaattttctatctcccctagtcacacatgtttgtgtgcgtttttcattgtgttttttcactctatcagcttccttgatcctggaccacatggaagcggaaggtattctgtggaaatgctccctgaaatagaacagagggacttcaggaagggtgcccaggttcatatttttacattactactttattattcttcagaatgtttactaccccaaagtttgttaggcgcttcatatattcttggtttagaggcattcttttaagtcaacatcttcagaaactaggacatttgtttgtgagaatgatgatatatcacttccatctttttatgcttttctaagttggttttcgtatgtgttgtagtggtttgctgtaacacgaaggcatgctttactgattttagcagaccacctttactacaataagttcgagctgtattgcaaggtatgttcctccttcattgattgttaattgttgatgcccatcatgctatagttcatttcacgtgtacagtgattactaagttattttggtagcatctaaacacaaatcctattactatagtgtatctagtagataaatgaaaataaatgcatcttcatggtgttcattgggaaccagccagtaacaggcatcacagtaggtaccagggtaccaggatttatcccaaagagggaaaatgataccctggtgatactgtcagaatgaagatcaaagctaggatgttagttgagatatgaaatttggaactgctattggcaattgtaaagctttagtagagatgataatttggagatgaactgaatttaagacttgtgccacttggttctaagttttaactgctttagccatatgctacaggaaatcaaaagggtgttaactcgtcaagaaaaaaaaatcgtgaagcacgtgtttcatatcgttgaaataatgtatatatacataatgttatttaatacaccaatttttttctgcttttttgtgttctgcagccagcagagggacgcaactgtattgctgatgagcattatttgccaaccctcttcaatgtcagtaaataatattttgaattgatatttagctttcttcttggtcccttgcttttctttcatatgctttcactttcatcttcagatggtagatcctggtggaatctctaattggtcagtgacacatgttgattggtctgaaggaaaatggcatccaaggtcgtatagagctattgatgttacctatgcactcttgaagaacataacggtatgctctacatcggtaaatggacacatgctttcggccctttgccaattgacatgtcctctatgtgtggacacttaccaatgtactttactgttgtgtaggctatcaaagagaacttccgtattacaagtgatgataaggtaatatagcaaatcttctttttcactcaagcacaaaaacaaatataccattactaggattttggtgatgattactgtgtttgtgcacttgtctgcaaacacctgaagatatttgcttttgagtgtctgcatgcaacgcagtcaaggaatttaactaaaacatagaaatgtagctcctacatgtaatattgatatgtacatttatcactatcgcagaaagttgtgacaatgacaccctgtatgtggaacggaacaaagagaccatgctacctttttgctagaaagttttacccagaagctctcaacaacctactgaagcactccagctacacgtccacttgagctctacacgattctttgcttttggcctaggaattccctaggatttatttcttcttctattttatgtaaattgtgaaattgatatttagctgcgtaacacagattcagggccagagacatatcaacgttgctgcggcaatggcgatgtcttgcaaattctgagtccctaggtagggctgaggcgatatttatttagttttgatacagccctcattgtaacatgttgtgcttttttgtatgttgctatgagctgctcttcacgcccacattttctctcttttctttctagtttcctagctcctcccatctgttgaggaataggcgtttttgtcagattggaactgttattatatgatccattctttgtagacatgaagagattattatgacaccagcacaaccttacagttaatctgccctcttgagttttgtttacacatactccgtttctgatgtgcatcattttctcttcgtttctgctgggaagtacagtgttctacaccgtaaactcaccaatttaatcaacgtacgtgtaaatactaattagttgaaaatggcagaaaattattcgaatacatctgatttttattttcagcatatgcatcgttttcatgttattcagctctgaagtgaaaatacacgcgcatctgaatttctgaatgtaaatcagtaactcgtagaaagggtatgtcttgttgctgcataagcatgtagccaagggcatgcatgtggtttattataagtacaaactttcttttacaaacattttacaaacgatgtgattaaatggagggttttcggggagggttttcggggacagcagctgcgggcttaaatgtgtggttatttctgaagcttttacattggtaactcttgttcactaccctaggggaggctagagtagcatggccatggcttgatctgctatggcaggagaagccatcggctttaattgttacggtccttattataaaccataacgatttattagcaatttaagaaaatgatatatgagtaaaattttatatatatgttcttagtgattgaaatgccaaatctaaaaaaaaaatactatgttgaaaaaccatcaaaatcaagttttactattcaaattttggctttggcttataagccataaggcaaacaatgaggcatgtaaagtggctagtgagcgatgtaattgttctttgatctaataaattacctgagttttaaaaaaaacgatgtgattaaatcttgatgttttaaaactccaatcgataataataactaagtagatcaaatggtttatttctttatcactccgaatttatttaaaagctcctttactagcccatttcaacagcccatctcaagtgagcacaaagcgagagggagggcccagcccacctcaccctcaaaaaccctaatcgagcccctcccgcatccatccaacggtcaagatcacccctcctcacgatccaacggccgataccccttcaccgaacactataaacaccccactcactctcccacctcccccttcttcctccccacccacccgccgccgccgtcgccgcccttcgccgccgccatgacgacgaggttcaagaagaaccggaagaagcgcgggcacgtgtcggccgggcacgggcggatcgggaagcaccggaagcacccgggagggcgcgggaacgccggcgggatgcaccaccaccgcatcctgttcgacaagtaccacccgggctacttcggcaaggtcgggatgcgctacttccacaggctcagcaacaggttccactgccccgccgtcaacgtcgagcgcctctggtccatggtgcccgccgaggccggcgccggcgccggcaaggcccccgtcatcgacgtcacgcagttcggctacaccaaggtgctcggcaaggggatgctccccccagagaggcccatcgtcgtcaaggccaagctcatctccaaggtcgccgagaagaagatcaaggccgccggcggcgccgtcctcctcaccgcctaggtactcgggagctagggttcttggcttcttgctatctatctaaagtgttagcttctttttttatctcttgttgtgttggaagacaaagcaaagaaagactacttttgtgctgttgctgctgttttttgtgttatggaacaaattgatggtatggctactaagatctgtggtggctattcatgagttttgattgaattacatgatcatgtaggtttatgtcaaatatttttgtgccgcatatcattctgattattattcttgatatcgaaatgctattgggaatggatggtttgtcgcatcaagatttgccatgtagtatctgtattgcctgtcagatgcggatgccaacctaatgcatttggatttgccttggattttggcgtaacctaatgcacatataaggatgcagttcactctaatatatttttaatagagcagcaaattttaatagtagaatttgttgggattataccggtgttattattcaggttataccattgtatttgggatcaacactagattagcatcacaaatctacaatggttcgagtaaatgtggatattgcaagagagcgagatggcaaatacagcatcataattctcaagttagcacgaagaagatcaagttgtacaagatgctctactcaagtcaagtgagaaggtgactaagttaacccatctatgttaaaattgcctgggatcattaacaacatgaatatggcaaattcatatcaaacttgaatgtccatgtttttgagagacagccattgccattggtacgaggtcaccgaaagggtcaccaaacggattggaagatccagcctgaggtgcagggtactgatgctgctgctgctgctgttgttggtatatctgattttgttgataatgtgtctgaaaatacatgttatggtgatgttgatgatcctggaaatgatgaggctggtagtattgttgctggtgttgagactggtagtactgatgctgctgctggttcagcattgcaaactggacattggatgggggcaagaagctgctcgacgtagcaaatggatcgttggtgtcgaaagggttgggtgctcctcctccaatgctaccggtgtaggtgactccggcgatctgccgccgcctcgtctcgtcttcgtagaggctgtcgagtagcagcttgtcaaagcctccagcctgttggatcagatcagatgcaagtttgtaattttttttggtcgtttttcagaagttttagaaatgagcaacagagcaaatgttatacttcctccgtcccataatataaaggattttgcatttttgcttgtactgtttgatcactcgtcttatttaaaaaatttaggaattattatttattttttttgacttactttattatctaaagtactttaaacacaacttttcgttttttatatttgcacaaatttttttttgaataaaacgagtggtcaaacattgtaagaaaaaactaaaaatctcttatattatgggacggatgaagtatgaagctagcagcaggtggagtaaagatttgtgcaaaccaatttggtttgaactgtttggctggtgctgcttggagcagtgaccagtgcaagctcccacccagatgtgttgccagaaaacaagtccagggaagttgatgccttagtttgatcacctgcaagcaaaagaccaaaaaaacacacaaaaaaaacattgatgacttcttttttggctcatttaaactttggcagcaagtccgcaaatttacagctaaatttaagtggccaatgttttgttatttgagattaatacagctaaatatacctgttcccacaattgctagggcccatgcgttgttttcttccagttctgcaaccaatggactcacctctgcatccaagttctgcaagatataaaacaaaaacagacacaaagaaataagatttagggaagtggacacttggattagcacataaatggattagagaaaatagtgcagaaaagtactagtagatctccagtggtttctggtggctttggttcttgtttaggctcttgttcttgttcagactctgcaggctcatctttctcctcttctgctggtttttcagactcctctgtagcttcttggtcgtaggtcactagcttcctctcaccattctcctgcttttgcaacaagaattacgaaaaaaaaaatctaaatccctttctcaaagtttgcaaagataagtttagagcagagtttgccttggttatccatagggcaaaagaaaactaccacccacaaatttcagaatggctagacagtttctaagtattttcacttgtataaacatgtatttataactttatattattattatatttattcactgtaggagcctctcctacagtttttttcccaaaagaaacacaagaactacacaaacataatagtactaatagaattgcactagttcttaagtacttgtttctcatgaagaaccgcactcaccacgctgttaatcgagggacggggtgcttctcggatgtactcttccattgttgcaatgaatgatgatggtggctgcagaatataatgtgcaaggaatgagcattagaaatccaagatcatgagggatgtggccaaattcatgaaaatgtttcgctatcttgttgctctgatttagacctaagataatcttttgagatcaagatgatgaactaacctgccttagagtaggaaactggaatgtcctggcaagctcaagttgtttgcaggaatcgtagaagtcagaaagatcttcagcctgtgcattggacaagcatgagggtcaaccattttcatgaaagaaaataccagattataaaattgagatatatacctgctggccagctcgtttatagacaacaagagccttgatagcatcatactttggcatatcaaagaactgcatcataacaataagaaccagaaatttatatttacaattcagcgacactgaaagcgataacctatctaggatgatattgtaaagaattcttctaaaaatggggcaccttcttcttttatataaaacatcgataacagcatatgactgtttaaaaaaatcataaagaattactttaccatatcaacaagattgatgataccatcattgattgcacagtagatcttgaagctctccttcaaaacctatagcacatgtgaaaccaccatatgatatttaagaacaaataatgtgttggataaagggatcagtaacctatgcaagatttcttgcgaattaaattaccagggctaatgcatattggataaggtagttcgtgcctgctgcaccttcaggctgcaatggcaaaaaaatatggatgaagctactgacaacatccaacaactttacaaggatgtgctagtaaaacattttggttatgaaacctggcagccaattagcctgaaaagtagctgctgcaaggcaggcaactgctccagaagttcaatgcaaggcagggttctagttctactgtgtgcctgcacttgttaggattaacgaaagtttaatcatcatgaggcaaaacatctcattcactacatggacttcgttttgataatgtgagaaagataatgttaaccttgctggaacactcaggagatctcatcagacgctcggtttcgatgtcgaatttcaagatcctgaaacactcgagccgttcttctaggaagagcgcgtaggcgcgaacccacgcagagcaatcccaagctggcaaaaatcaaggctagctaggtgagttgatgcatcatttctatcctccaattagagtttgatttgggaaaaatatatacacatgactctctgttgcattgatcactatgcaagatagggaatcacctaattggcttgaatcgtccttgaagtttgctctctgcaaaacgcttcccttgtatgagtaggccaggaactcttctttgaatgtaggatcaccttctctcaagagcctatgtaccactatcaatgtcttcaatgcaacctataaccaaaaaatgtccatcaacaagcacattatcgagataaggaatataatcaaagaggactgtaagagcaagacccaactgtccaattctttgtcttggacaatctccttgacaaggcatagatgcagtattgaacgtccgctcgagggcggttaatggaggtcgccacgaatatttctgcaacaatgtgattagaaaaaaaatggattctaagattatattacctgctgaaagagatacattttggcattaaggtagccaactaaattatggaggagaagatgatcgagtactcacttctaacgtgcctgtccttgggagggcattctacatggttggtggccttcacaattgcaatatccaactcctgccattgaaacaattaacccagcaaatatcaggtaacatactaccctctttgtcaaaaaaaaaaaaacccaataacatacaaggatgtatatagataaatgtttgtccaaattcattctagaaataaaggatgaatatagataaatgtttgtccaaattcattctagaaattgattatttttaggacagagggtatacaaattatgcatttgccttcatcctgagacaatgcagcatttgcatggacaaatgcagctaagctaacagaaaaagcaagattgcaagaccatatgaacaaaattccctacaacaacagcagcaacaacaacgagaaagaaaggaaggaaggaaggaaaagaaagctgcaagaacatggacaagtcgacaagaacaggagagaaattaatggaggagataaaaaaaatgtagtgaaggtgacggaccttgaagtcgctgttgaccttggcgaggccgaccttggtggagtccttgagggcgccgtaggccttgcgccgccacgaccccatcgcgatcggcgcgacggcccggccgcgggcgtgcgctgagacctccggacgcccgcacgtactctctccctccctcccgctacggacgacaacgacgacgacgacgacgcaatgcgacgcggcctccctttttccgatcaactcctccctctcccgctaattttagcccgcccgcgcatgcgatccaccgcgccgcgcgcgagctaagctccccaactccctccctttcctagctcgtgcgcgcgctcgcaatccgcgtgtttgcaattttatttttgggttgattggaaatatgcccactcaggtaaattttattttaattcatctagtcgtattcatgtcattcgaattcgcacaaaattaaaatcataccatcaccgtcacattttcggttatcatacagaccaaaatacccctagacgactagacgtgggacccacattttagttccatcttcttcctccgttctcccatcttctttctttcccatctctctccacatgctagttttatcttcatcagtgaagccaccccacagccgtcgtaaccctagtccccgcaccctactcctctccttgccggtagcaagagcttcgacaagtaggggtgggcatttggttagaccgaaatttgtggtctcggtcttcggtctttcggtcatttcggtttttgaaaggtgaagaccgaatttcaacgcaaaaatattagaaccgaaaaatttcattaatgaaaatgttgctaaatttcggttaggaccgagaccgagactgagaccgaatttgtcggttatgatatttttgcgttgaaattcggtcttcagcaatattttcaatgctgcctgaggaggaggccgagcccgacctcgccatcctatgcttgaggtcaatgcattcctcgcctgaaggaaggaggacatcctaccgaccatctgagtcagctgacacgtcgaataaaatcggagtcaaaaaccaccgagggaacttgcactggatttgtaagttgagagatgcgttgtatccggttttaaggtcgagggacgattttataactcaatgacaagttgagggaccttcggtatacattttccttttccgaaacagtgagcctctacacatgtctgtcacacaagcccaggtcggcccagcctagcccagcccaacccatccccaccccgtagcgaacaaatccatcccttgaccacccacccacccttcctcctcctcctcccgtctcggaagccaccaaaccctagccgcgagccctgacgttgcgaggaaggggaagaggagagatcgagatcggagagatccatccatggcgctgcgagccctgatcagcgagatccgggggatgaaggtgcgggaggtgccggggtacctgaagccgcggctgagctgggagaacgtgaagaagagcagcgaccaggccgtcgaccgctacatcgacaagtacatcgagaccagctcgccggagccgctcttccacgtcatctacggcctcatggccttctcctacctcatcaacctccccaaggagcgccgccacctcgcccacctcgaggagctcgagaggcagggcgccgccggcgccgcccaccactagatccgaggtcaggtgagggttcccccgtctccttgcctcccctgatctgatctgggattttccccgattgtttcgttcggtgccgttgggatggttagattggaaatgttagctatggagatatgaggaaatgtttctattcttaaaatctatcacgagtggttggggatttttttttaatgcatttcaatcacggtgcaggagagggatctggattattatagggaaaaaagtgatactagcttttcaggagtaagtttaattagtttttcatagaattaaatttgtttcataggaaaaaacaaatgattaggaattttttgttttttaaggagtaactttgattaggaatttttttggatcgtatgttgctccatttccaccacggtgaggataatataggttataggaaaaggtaaatgatagatttaaggagtaactttgattattaggtttttagtacaactgaattggtttggtggtcgtgatccatttatcctttgacatagtactgcttggatatcagcaggcctctccaccgcaacaagttacaactttaaatatatatcgagtcctgcagagatctactaattttgtgcatttcacgctttgctttgtttgcttgtcttgaaagggtgaaacatatttattgataatctttagtgtagtgtatggattgaagcaaacatatttattgataatctttagtgtagtgtatggattgaagcatttgctgtgtgaatggatgcatcttcgctgtttattgtagtataaatgtagtgaggaggagagtcacagctattttttgagtcagtgcataggccttgttgttcatgtctgttttgcataattgaaatgaaattagttgaaattatgcatattgctgtcacaccatatgaaacgagcatcttctgacttaaccttggtatactgtgaaataaccttggtacaatatatctgtgaaataaccttagtacaatatataatagcgtagttgcagcattttatgtaatcctcttcaaagttgcatgagttcaattgctacctggttagatcaatgattggcagatcttcttttaagaagaacaaacgggcactcaaacagtcaaactgatataatgttttgttgaacttccaacatgctgatataatgtgatttaggagtaatgtatgcctctactgtagaggagttattcacaagggaaggtctgcaatgcaccttttgattatgcaatgtctctagccactccaatctgcaatgcaccttttaattatgcaatgtctctatccactccaagctcatactcgaatgttcatgatttaaatgttgtcatacgaaccccactgcaactgatgtgaaggctgactacatgccctgttttatctatgctgtattgcaggacttggggtttgtctgtggttgattcgatctaacagaatttctgttcttccaccgatgagctacctggagttgtgatgatgttcgtttgatggtttattttgtacggaaagtcagcaaaaaactttccagtttattgttacattcctatgcatcttatcataagcaacttcaaactggaagtgcatgcattgtgattaaaaactttttcagttaatttgagcacagctgcttcgatatatactctaatgacagctttgtcggtcgtttaatgtatttccctgcctttctcatcttataggcataacatttgcatctgctttgttttgatgcagtttgtatgtcattaatcacgtggtgattttgtggccttttcttaagcttgcaagacttcatctcatgtcttttttttgcttgtgtatccatcgctaaagattgtagcaatcagagttttcggcctgatcttttgttattctaacaggctacagcccatggattgacatgcactgatattctgtcatcctgcaaggttgtggttcattctcgtcatatcaagttgtcaacctgatgaagccatcacggtttactttatttttaatcttttgaaacgaaaatcctttttttttcgagaattcaagttttggccgctgtacttgctgaattcctgtccaacgggaagatcaaattgaaagcaatgcaatccaacagagcccataccgtccgtctaaggtagaaccagccgttgtcgagctttcgatatcctttcgtggtcacgcaatcgaacccacaattcctcccaaaatcgaacccacaaacatttcctccctaaatcgaacccacaatgcgaggctccttgtcgtccttctcgcatggattgcaggttgtttcatagatgagtgcaacattggatgccttggaccttgccccttttgtcggcaggctaattggttgcctcatagatgagcgcacaattggcacaatttgtcattgcaagtgatcaaattatctcagaatttctagttactactgcaagaaatgcctctcttggcaaagcaaagagtagttccccatcgaatggtgcaaaaggttgcttccaacgactagttttaaattccagtttatattatcaagaacaatttacaacaaaataattagacaacaaaaccgaaatacactgttcaattccatcctatgcccgacgtaccatgctcaccatccatactttgcttgagtctctgcttttgtgaggaatcccttggaacgcctctcggcaagctccatctccttttgcttcatgtcatagaatagagaaccaatctggtgctttcttttgtgcagcttggagggctttccttttgctgaaggggcgggctgcgttcaagatagaaatcttgggttagaacgatccttacttaattagcgatgcaaatatggtttggtttttcaaaaatgatatcttatcacttatgagctcatgatgctcactcacaatttagatcttttcaaactaacggtggacatgatgacatataaacaccttatggcaattgcaactttaatcatgttggaaacttatagaatccatcttttttgacaaatttcctttccaccatcatttcaatgttaattactccctccgtttcacaatgtaagtcattctagcatttcccacattcatatagttcttaatgaatctagatataactatatgaatgtggaaaatgctagaataacttacattgtgaaacggaggaagtaataactaagattgttggtcactgataagggatgttggatctgcaaaaaacatcactcctattgctttccaactgaaatcctatagttcacactgggaagctgtgatatatgttccatatgtacataagttaacctaataccctttccacccactataatttaaaccttttatacagaaccagatctagcctacagtcactggccaaataaaagtagatcaaatgttattaatagtacatgcaaatagcataaagccaccacccaggcacccaccaacagaaacgctgtatgaaccataagtaacataattatcaaattatgtccttacagaggttatcagcaatcaataatatggctgacataatgaactgcaaaattacaataagaaagaaccactgtatcatgattctgcctatgtcctccaataaatacttgcttgggagcttgcagcattctaaactgatcacaagcaagtcaaataaatactactgtatcgcttaaccaataagccaattatcttggtaccaacaaaccatttgtaggaataactacagtgtcgggtgctctaaccagtcatagtaatggataaaagattacagttactggcaagagagtgagctactctagaaatctcatcctattatgtactacatgtgatacttgccagaaaaataatcgaacataacaataatgctgcaagctaagtagaaatcataacaagctgactcggtacctggtaactagggccgaaggccatcccagtgagcttggacttatcctccctcggtcggttcttcatcagctctgcctggttaacctctaaaatctctgccggcatatcgctcctacctctcttccctccaatcctaccaacctccggtggcagtattggctgctggattggcggtgctgtcgctgcagccgcattatgttcgtacccaccagcatagccccctccatatgccatttccgtcgaatgcccatatccatcaccatgttctactccgtatgtatttccatacactccaccgtgctctcctccatatgccgcatactgcgcttcagtcccatagttcacattgccgctcggatcccagccatagtttgcaccgtaattggcgtagtaatttggatcccatgcgtagccttcctgtccattactgctcccaactccagcatcatagctttgctgctgattctgctgctgctgtccagcttcggaatcaacagcgagctgctcctgctgctcctccggcacaggcatctcatcgtcatcgctgctcccattcgattcatcgtcttcatcatcggcagaggtagtatcaggcctttcgggggcaattgcgttgacggccgaggacgatggaccagcggcgacaacattcgacctctccggcgcagcggtgtctatggccgacctcctggcggcgccgccaccgccgagcccgagggagcgcttgggcggcgggaggaacgaagagacaggccccgtgcccgcggatacgggcgggcgcggctcggcctcgctagggcggcgcttctcggcgtcgtcgtcctcctcgtcggagctctcgcccgtgggctggcggatcggaggcgggcggaactgcacgacccgcttagggttcccggaggaggacttgggaggcgggatggcggagaagacgggcccggatttgggcgccgggagggaggagaagaggagcgccgacttgggctgcgggagcgacgagaagatgccgccaccggagggcggcttcggtcgggccgcggcggcggcgggaggagtgggtagggtttcgtcggcctcgtcgtcggaagaggcgtagttggcaagaagggaatccatcgcggcttgcggattcgatcggcggcgcgcgggggaggagagcaggggtagacgcctccggcggcggcggcgggtggggttcgattggaggtggagtgggagtcggagagtcgtcggcggcgggcggaggcggaggcggaggtcggggtggatgatggcagggaggcccgaagtggatagatgggccgggcttagggccagattaatggcctttttcgtatagtactggtaagtttctgccttggaatatgtaactttttttttcctttttgttcatataaaagttgaacgattttgctattttacttccgatagatttttggcttctatcttttgcttttccgttcgtatgattttgtaccaagttttatgttcttgtatatccaatttgttattacgctcagttacagtacatttacacttaccgtctatgtagcactcatagtcagttactctataccaaagttaaattttagaattattttgtctctctatatttacaattgtcggcatgtttgtctatttttcttatggttattttatttaaaacgggctatatccattggttaaaagttatgtaaaattcgaagctataaaactctaaaacagtaaaattcatgcattttgaaaagggcttaaatattactccctccatccctaaatgtttgacaccgttgactttttaaaatatgtttgaccattcgtcttattcaaaaaatttaagcaattattaattcttttcctaccatttgattcattgttaaatatatttttatgtatacatatagttttacatatttcacaaaagtttttgaataagacgaacggtcaaatatgtttaaaaaaatcaacggcgtcaaacatttagggaatgaggtagtattatgctagacatagttgcatgctatatgatgccgagagattctcatgttgcccttacaaagtgggtgttactaccataattgggcattgttcactacagccacaaaaagaaaaaaaaaatgtaacgtctcatatgttaccgcagttaccatgtggctctgtaatggagagaattttacatggttttttttcttactggagtatattttcagttttttttagaacaattagattttcagttaccaatctttaaagtggacaagaagcttgaaaaaaaactttgttaaggttaaccttcttcccataatactaagaaaaaagtataatatgtgtattagtttggattgaggtcaaacgtttggtagtgctcttatcttatcttatttatcttatttgatcatattctagaagtttcttcactatactatgagaatttgacttttatattggtaccaatccaaatgttagctgaataattttactttactaatattttaatattgctttggcattgtcgatgaattggtaggctaaaggccgagtctagttgttttggcaaaaaaaattgacatatacgaacacatatttgaagtattaaacgtagactaataacaaaataaattatagatttcgtttgcaaagtgtgagatgaatctattaagcctaattaatctgttattagtaaatatttactgtagcaccacattgtcaaatcatggcgtaattaggcttaaaagatttgtctcgcaatttacatgtaaattgtgcaattggttttttttctacatttaatactccatttgatgtgacaggaaagttggaagttgaagggaactaaacacaggccgagtttagttgtaaactttttctttaaacttctaacttttctatcacatcaaaactttcttgcagacataaactttcaactttttcatcacatcgttttaatttcaacggaacttttaattttagcgtgaactaaaacacacccacagtaaaagaatcaaataagcccatagcactaaaaagttgcagttaggtggagttgaaggtcgccgggggcgggagggagggaccaggtcaggtgcgacgctccctcctgctgggccgcgtggccgtgctcaccgtgtcgctcactcacgcgcgtacgcagttgaagccgcctctctcgccgtctcgcgtacgatcgctacgagaggccaccacgaggccttttttttttcctatctgcttcactccctcttgttcctcatgttaaatacttcattcgtttcgtttcataatgtaagtcattctagcatttcccacatttatattggtgttaatgaatctaaatagatatccgatatgaatgtgaaaaatgctagaatgacttacattgtggaacggagggagtatgtctcattttgtattaggcctagtttttttttcaacttaaaacttcaatttcgatttttgttagtatgttttttaaaatgctaaatgatatgtctgttacaaaagtttctatatagaagttatttatgaaaataaaataaatttattttttaaatttataataataatgcttaattaaacatgtgttagtcatctttctcgtttcacgtacgctaaaaatttctctccaacacgacagaacgaacgtagccttagggtttattcggtttggagataaagtaaaggattttaatttttatggattagtttctacaagtaccatttgggatttgtatgaataagatataggaaaatcaaatgaaaatgttcctttcttacaagtcgtagagagaaaatatataaaaatattcatccactcaaaaaaatttctatggattaatgggttcgtgtattactatttctccacttttttttattttcatgggttgaaattctctcaaaccaaataagccattgagttgtaatattttaggagggaggtagcacgtgctatcggctcaaaagcgatcggcaagacatgaggacagcattccttgatcattggctcttcccattcaagctaacacgactggggggtacacactgttgttagtgctaacaatactgtccatacaagtggtaagcccagtacattgagataccaactaacaccaaacacaagacaggactagcaaagattggaaggaaaaaaatatcgagttggtagttggtactatacaatacagggagacattcttgaccacataaagtctagttgatcaaatcacctttaattaataaccaattaataacaaatcaaattgtactatcatcattgtatactaatactacacagaaaaattagagtcccatccatttggatttagacttgtgatttgatgttaaccacaagagaggccttcctaaaccacaagatttttgggtccttgatggtgattaagaatttgagattaatttaattaattagggaggaagcaaacaaacaatcattgcccacaagtttcgcatttttagtactttctatctcaggcggccggaagattcgtcgtgcggtggccggcggcggcggcggatcaggagcactcggcccagccctcctcggcggcgggcggcgtcgacgcgcgcgccatccacgacgccaccgtcaggagcagcctcgccggcacgtgcgcgctggcctccagccgccggagcagcgcggcctgtccggcgccggggcggcggcggcgacgggaggaggaggaggcgacctccgaccagagcgcggcggccatcgcgacgcggatcgggacgcgggaggcggcgacgccacggcccaccgcgcggagcgccgccccggccgcggcggcgcgcctgcgcgccgcgcccgacgacaaccccatccgcttcgcccacccctccagaaccgcctccgcgcgcggggcacgccgcccgcgccgccccctcctcctgacgtcctcgctctccaccgccgccgccgccgccgccgtggacgacgcggagtccgccgtcgacacgcacgagctcgacgccgtggaccgggcgtcatcctcctcatccaccacctcaacccccaaccggcggcggcggtgcctggacgcgaggaagttggcgccgtgcaccttgtcgtcacataccaagcaaagaaacgcggagtcagcggcgcagtgcaccgcggccacgcccccgcacagctcgcacccggcgccaccaccgccgcacttgccgttgccgacctccattacaggttgcaagaggctggactcttgtgtcactcggtcgaacacctggcgggggtttgcgtggctttatactacagagcaaaacagggacaccagtctccgcgcgagggcgagatggcgatggcgaccggcgggcgcaggcgcgggcgcggcgcgcttcggggaaaccggcggcgagcgggggaaaccggcggcgagcgggggaaaccgcgggcgcgcgcgcggacggcgaggggggaggtttggttgggagcgagacgatgtggattggaatgagtcgagagtgcgaggggagtgtggcctgtatttaaagaggacccgcggccaccggctttggtggtggctgtgcctcgctctcctctcctcgcccccatcgactagtaggattttactttgaccttttcccgctcgtttgtactactaaatactccactccaacatggttttttttttacaaagttctttttttaaagattcaggtgtgtttatttcgcgctaaaatttaaagtttggttgaaattaaaacgatgtgacggaaaagttggaagtttgtatgtgtatgaaagttttttggaactaaactcagctgaagtcacagttttttattgaattatttttcatatataacttagagtataactatatttaattgagctataactataatattataatcacattgtaacattctaacttctatgtagcttactctcggagctgtgttggccaagggaaggataatggtgttcaacctaaggtaaaatatcaagtgttggctagcgatatggtcaaacaggaacgatgtggtttttaatggtgtgttaaaactttattgtttaaaaaaaatatataggtaacttttagggagattcattgggcgcagttttggtctatgttgcttaaattggaggatgacattgtgttaaagaaaaagtgtttcttcaacaggaacatcgggaggagattagaaacttaactttgtattttttttttggttggttaacttttgtttgagacatgttcttcgtgtaaggggttgagtcttaactcttaagcactcttgtataaacttttggccgtgtaatccatttacaaagtagagatcgggttttaactcattatctcaacaaggaaaacagctgcaattagcacaagtaatatgatgccctacaaattgttctaaatttaaaagtcccatcatttggcatattagagaaaaaagcaaaacgacttatttgtaaataaaaaataatttatgaataaaacttttttatatgtgttcttaataatctaaaagtaaaggttaaaaaataaactacgatgaagtaaaacctaaaaaaatttctaaatataaggtttaaaatttaaattttagctaataagtataattatatcttctattatacgcagaacaattgtcgtacggaagctgaccaatgggcagtcggcgcaagagttaatccctcatctaactgacgtaacttttagagcaccgctacacgtactaaatttttcttactaaatttgtactaacaatcatctcaaccgtttaattcaagtagatgaaagttataaaaaaaatctagatacacttatagcatgatatgtcagtgttagtaaaaatttagtaagaaaaagtgagtacgtatagacttttcctaacttttaacacctaaaatatgtactcccgggcaacatgatctgatcatttccctagatcaaactgaaccttgtgtctatctaacaaaatatgacacacatgacaaatttctctaacatatccacccaatccccttccattccgatctttctcgtcgccaaccatcccaattaacaaaaaaaacaattaccacttgtgaataaaccaccattcaggtgtacttttcacatgacactaggagtattattctataccatgttggagtgattatctaaaaaaaaaaccatgttggagtgatgcccgaaatatattatctgttcttctgacgagctagcggccaccgttaaacgacaggtaaataattcttagttaattactccctccgttttaaaatatttgacgccgttgactttttagcatatgtttgaccgttcgtcttattcaaaaaatttaagtaattattaattcttttcctatcattaattcattgttaaatatatttttatgtaggcatataattttacatatttcacaaaagtttttaaataagacgaacggtcaaacatatgctaaaaagtcaacggtgtcaaatatttcgaaacggagggagtagcttgtgtgcttaatgaaattatggacatacctgagccgttggttggggagtcgtagagtgatccttgtccacaaaaacctcgtcgccttcgaagagagaggccagattttttttctactttttttggggtcaaaagagaaatattctttcacctctcctgaaggaaaagtttctacctaagctagttgcttggtttctttcggtttggaattttctaattaatctccaatttgagcttttggattgggagatagagagatagacataattagtatgaataatgttgttttcctgttcactctatctctagtttgtatggggccatgagtgatggaatgtccactgaattattgcttatgaaaatgttatccagtgtcaaatcgatctatttgatctgtctattagctagcttctcttttcatcatgctctgtatgtatggaccaaatcctgattattagatgattagtttagataatgatgcatttccttttctggtgatgcaggtccacatgcatatcagcatatgatgcacctaatttatatatacattttttcaaggatgacacacctgattgatctgaccatccttcttttgtcaagatcaatctttcttacataatataaaatgatttgaacaacaatctcaatagcacagttacacaacaaatcacagccagtttggtttagagccataccaaaatattgatagtgtcaaattttaagcaacttttgacactatcaacttttggcaccattaaatttggtaggacaaatttgctactacctaacagatggagctagtaaaaatgggcaccaatccaatatctagaaacactgtttaaaagtactactaacaaagaattggtaggacaaaaactagtcctaaatgatacatggttcatatatatagtaccatttccgtatcataataattgtaattgtagattgtttagcatatattaagatttgagaagaaaactataatgtctctcattaaatgacatattacgtgagagtaggaaagtaactaagggtagaatatataggataaaaatttaaatgaggagtgattgatagaacagttaatactctgtagcgacaattattttaagacaaattctaaatactataaatacaattcatttgggatggagtagtatatgatttttttacacatgctacagtaagaaatcttctcatggtcatggcatgggacgcaaaaagaaaaaaggaaaaaaaagaatctgatcaaccttttgttggcatttttatatttgtgagggtaggagaggtgacagcatgcgatggccgatggagaccatgcgattaactagaaaaatgattttagggagttaggcaccggagcgctcgtggctccgatcgtcgcccgttaaaagattcccatggtgtggggtcatgatcatgagagatgagcttgtgtggactacaatccttagctaattaatcaccgttaatcagaggctttaatacgctaataaagcgtaatttgtgtgtgtgtgtgtgtttaattagacacgtacatctgcagagacgacgtcgacgacgagctagtaacgtctgggagctggatcagatcatggcgtgtcgcgtgatcatagggtttggtttttggaggacagggagaccactagaccagctgacgtggttcctttctttgcggttcatatacgcaacaacgcctcccaggacccaggtggctttggcttttgtttctactctctttaaaaaccaatgtattagatgtgatgttttagagcaaggctaataatacagccgacctgttgactataaggttctttatagccttctcttagcctactcatataaatagttagctctttacaattgatacatggcccacttgtctctctcacagagtttttttttgttcttgtgtctaagccggttattagtttacagcccgtttctcctctctcctctcttctctcctatatctcagcatttagctggcttatagcctactattatacttgctcttatagtccaacgaatctaaacagactcattggactataaaacatcccatcgaatactaagttgtttttttggacggagtgagtactcactaaacataaaagataaaacacgaaaaaaatcattagcatacggagggagtactcactaaacataaaagataaaacacgaaaaaaatcattagcatatatgattaattgagttttaattattatactcttaacgaataattttatctttcgttttaaaacaacttaaattcatattttatatatatatatatatatatatatatatatatatatatatatatatatatatatatatatatatataaagttttcatacagaatgtaatgtttaataatttaaaaagcatgcaatgaaaatcgaggtaagccatgtatcttgatcaagttaaaacatatgcctaggtgaggtaatactaagccttgtttaagctctaggtagcagcagattagtggtctaaaaacatgatatttactctagaatttgtatagaacgattaatcgatatgttattaatgtaactgtgtacatcctgatatgtggatttatgtctaatttctgaaaatatataattcaatcaaacttttttcttaaaaaaaataaaacccatctagatgcataattgtcggtgacatgggaccgggagtatcatgacttagagacttgaggcagacacgatcacccacgtggcctaaccccctcgggggggtcgggcccgagggtgatacggccgcccttctctttgtctccccgaggggtcggaccgctcccgtctcggccccgagggccgaggcgccccgaccccttgtgggttttgcgccgcgtatatggggaaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggaaccggcgtgttagctcctggagatggcacgttggttccggtcagatatatgccaggcttcatcctaaccattacaggcaagatattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagagagagatggtgcatgtggtatccccttgagatataaaaggaggaccttgcccacttagaggaaaagaaggaggagaaaacgatcccggaacgatcgggggctggctcgcactttgtaacttcttcatacacagatccaccaaaacacaggagtagggtattacgcttctcagcggcccgaacctgtatacatcgcccgtgtcttgtgttttttccattctcgcgaaccttccacacacagactaggagcttagaatctcacccagggccctcggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcagcccaatggctgaacaagcaaaggcgcacaacctctctccgagtgttagcggtgacgacggggagccaaacccacgccgtcgagctcgtactccaccgccccctccacgccaaagtcctaggcgggaggaggcgctcgagagggtcgaaggatctgcgacttcgacatccacgggtgatggggaagtgcggcgagatggggagcgtcgtctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgcaaggaggaggcctggacttggaacccctccggttccggtgtggcagcttcggccgcccccgggtccgccgctcggtcagggcggcgggacaggaggaggaagaagaggtcggcccattccgacgacgagggtcatgtcctcgccgtcgaaggcatttcgctggccacccgaaagaggaggcctgcgagcgacaaaaagaaggaagccgacgctccctgacctcggctacttggaagagcgaaggtggcgcgcggcccttcgagccgcgcgctaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggcttcgtttggctggccacgggcgacggcacagagctgcctaacccgtggaacatcgaacaccttcgtcgcttctacccctagtgggggtcgggtgtcaggtcttgggctcgggccaaccccgcaccccccggggcgtgcagggttggccgggggcttatcttttttctcttccgtatttcaataaaagcattttcgatttcctaaaggctgtgtctgtgcttttgtttccttttgaagaatcttgacttgaaataggtcacttgtgctcaatcctaccctcgggggctcgggtcggctaaaatcgccaaaaggggcccagaaccgagccgtgccccgggacgtggtgaactccgggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaagggggcccgaaggcctcggaagaagaaggaaaagctattaagattggcggaggcctgggggctcactccgacgtgcccgggtagccggcctcgccgtcgctgtcgtccgcaccgtcgtcaccgcactccttgtcggagttaaaggcaaacgcgaagccgaggggccgctcattattgtcggtcggttttcccttgctgatgcgcgcgatttgcgaccgccgggattctgcccgaagagagagagagcagggaggagaggcccccgagccgaacggcggcccaaggcccccgacggccggagctggccctccgcctgcttgtccgacggtgccaggcgcccacgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcggccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctctgtccccgaggccagctcgagctcatcgcagctgcctcacaccgccctctgggtgatgtagttcaacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgacttagagacttgaggcagacacgatcacccacgtggcctaaccccctcgggggggtcaggcccgagggtgatacggccgcccttctctttgtctccccgaggggtcggaccgctcccgtctcggccccgagggccgaggcgccccgaccccttatgggttttgcgccgcgtatatggggaaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggaaccggcgtgttagctcctggagatggcacgttggttccggtcagatatatgccaggcttcatcctaaccattacaggcaagatattgtatgaagaggggcgaacatgcagattgataaactgacgcgtggtggacaagaatgaccgatttgtgaccggtctgacactgatcatgtcgtcagcagacagccatgttcccacgtcgcgcctgcttccgacggaagtggaggtaggtatgggccgtcccatcagaaggtcattcggacggcagccatacaaatctccgtccattaatgaagagaagtcaagttggagggaagagaggatgagtccccacacaaaagaaagagagagagagatggtgcatgtggtatccccttgagatataaaaggaggaccttgcccacttagaggaaaagaaggaggagaaaacgatcccggaacgatcgggggctggctcgcactttgtaacttcttcatacacagatccaccaaaacacaggagtagggtattacgcttctcagcggcccgaacctgtatacatcgcccgtgtcttgtgttttttccattctcgcgaaccttccacacacagactaggagcttagaatctcacctagggcccccggccgaaccggcaaaggggggcctgcgcggtctcccggtgaggagccccacgctccgtcaataatactatgatatgtctcatctacttctaatttattatattttggaatggaaggagtatataagcggggaaaagtatagtaggagtaacttgatggatgattgtcaccgtaccagacataaattagtttgttgcctctttttgttattaaaatcccatttgctaatactagtaaaaagaaagtccgattttggttagtcgttttttaaccctggctccgatcgcatccacggtagtagctgctgctgctgcgtacgtgcagctatctcatccaacaacagaaagaagggaaaaaaaaaacgcgcacgtccccggtcggttcggtcgactgtgtatggacggccgcaaccgcacgcacacactcaccgtgtcgaacacagcagcagctggtggctttgtagccctaggtcccgtaaaaaactaatctagaaccgaatataacatatattttagtactacgaatctagatacttccttcatcttataaaaaaccaatatagtattggatgtgacacatcctagtactaataaatgaccagctaaaatatgtcacatccagtactagattcgctgtataagaatatgtcacatccaggactagactcgtttttttatagagagagtatgtttctatatataaagattgataatactagaatgtgtcatatttcgatattattggtttaaagcattactggagttacaatatataatatgttatattcggtattaggtttggttttttatgcaacagagtgagtatctggctccctacccgatcgagcacgtcacgcaaaccgaccccgatccgtccgtccgtccattcatccatcgtactccctccgtcccaggatataagaagttttagagttggacactgttattaagaaaataggtaaaagtgagggccccattgattcaaaggaaattcataggtattttagagaatttcattcctatagtaatttttcttatatagccctttgaatcaaaggaatggatcctatgaaatcctatgaaattcctatgaaatgactcttcccatgtaagttttggaggaaatttaacatgaggtagaacctcatgaaaagaatcctttgagtctttatctctcctcaaattcctgtatttttcctgtggcccaattaaacagtcattcctatgtttttcctgtgttttgcaatcatctgttttacacttgcattcctatcagaatcctatgtttttcctattcctctgttttttcattcctatgattcaaagaggccctgaatggtgaagggttgtgattggatgagtaatggagatagttgggaaaagtgaatgacatagggttgtgattggttggaaagagaatgctggtggagaagttactcccctcgtttcacaatgtaagtcattttagtattttccacatttatattgatgttatatgtctaagaaatattagaatgacttatattgtgaaacggaggaagtattatgggataaatcctaaagactaaaagttgttatattttggaacggatgcagcagtagtatatacttttttttgagaacagcagtagtatggtacttacgtgcagccttgcgtatcagtcactcgatcgatccgacgagggcgagacggagcagatggatggatggatggggttcgccaggtggaggccggctttgctgtcgccagttccacggcctgcaggcgcgtcggatgggagtcagtccccaccctatgcctaggcgagtagagtaggccacctgcccctggccgtacatatgtcccgttcaggaaggcggtgcggtggtgggtactgtacgtgttcttgggaccgagataagagaggctgcgatgcatctgcacctgctcccagcctcccaccaccattcagcggatacttctatcatttttggcgaattctgtttctgtcatcacgctggagctatgatgatcgcttcttctgaaaggaattagcgtttttctttactccctcgttacgaaggctttcacggtgcacggagttattatttagcacgaaccgactatctcagatattcggctccatgttatctggtctattttgttgcccccacaaagaaccgggagccaaattaagctacaggttcctcgtcataatttacaaatataggctcatactctctgtcccatatcactagggaagggatagagaggactggcaggaggagaggccctcgtcatcatacccgtgcttcacgccgatgggcttgtcagccaaggaaagagggtgacactgtggccgcgaaagagaagggatgaggggggaggggggtgagtagcatcactgccattcttgtcctcgttgtcccttgaggtggtgtcgaacgtcgcgtcgagaggaaagggggtaaggtggtgtcggatcctatgagcagctgacgctacccaaggccggatccgatgagccccaagtcggattcggcgagcatagcagcaccgtcatctcccgcggcggccaccccgacaaggagaggtagtgctccacccggcgccgtcatcgctctgctcggcacggtcgccaaatccgcccccaagcacattgttcccttcttctatgcttggctagatctggtcactccgcccgacacctcgctttcttcgcccagcacctcagcttcctccgccgatggagaaagacagagaggagagagggggatgaaaagtgggagaggagttattggtgggacccactacaaatacaatgagtgtgtatccttagaggggcttgggcctaggtggcaaccgaggcccaacaagtgcaataccttcactcctatcgccctaagtttgttttgacttatgtaagatttacaaatttgccgttggtttttttaatttgaaatatgccagtatgccacttgaacgatagttctggtggtatttttataattttttagtgacattcttgcaataacgattcaaactagtggtaaatttacaattgcccctaaaaaaaattatgttgcaattgcttactcttgtactcgcgatccgagtgccaaagctaaatgcagaaaacaaacaattctaaaagtaagttctagtacaatttagaatttactacagtttataaacaactgctcaaaccaaaaaggttctcaatttttttgtgtacagttcagttttttttttttttggagaacaccttggctagagcttggatccgacccaaaaaggttcacttccgtaagctggatcggacaaccgtgcttagcttctccaccaccaagttcttggcaatttaatcgtggtgccataggcctgataatgatttcatcaacaactagctacatgaattgatggatacttttggtattaatcgcttgagaaaaccccatcttcggtcttccggtcgatcataaacacatcagataggcgtatggttcacatgttggtggtttctttaaggcttcgattagtgcacgcggaattttctctagaaggaacaccagaaggaaacatccgctttcactggatctggatgtgaatttttctcaagattttccggtaggcatcatgctcctccgaattcccttgaagttttcattgttcgctccaataaccgctcatttttttgttaaaattctacaaattggcatgcttcttttcttctttcacctttgcgaattgcgatgaatacatgccacctagcgtatttctagcgtgccggcacccggcagtcaaaacgaagacgtgcggtcaaaaacgtactccctccgtgtgcatacatgattttccgcacccaactttaaccgattttccgcacccaactttaaccgttcgtcttgtttgaattttttttaaaaaaaaattaaaaacataagtcaagagtaaagtaatttttatgttttattatctcagcaacaaaaatgctaattataaaaaaaatttcaaataaaacggtcgattaaagttggacgcaaaaactcatagttgcgcttattttaggacggaggtagcaagagaagctctgcaaaatgccaaacccggctgttctgataggacgggcccacacgacccggaaaaccgagaccagccacaaaaacgggagatgccatccatccgtccttccggttcgatgcatcgggtcaccttcctccagcaacaagccaacaacgacaagtctcgacgagattcatgcacgatgaagtcacgcgtgcgatgagaaaaccgcacgcgtgtctgtagcatggcaaaaccagggatgcgccacttgtgccgctgcgacttgaagctcactcgcatagtacattcggttacttccatgttgctttcaggccaaagagagtacacgtttggttcaaattcaacccgttataacttgggagttgcttcctgcgatgtcacgcatgatctgcccgccatgattctgcaggatcagtaaagatcccactattcagcaaccaactgcaattggcaaggcaaagatatgcatgagtgtgacagtgagatgagagctaatatgaaccactacaattctaattctgttcaggttaagaaaagaaaaccggggagacccaaaaccattcatgaaacctgcacatctgatctgcatttcatcggtcaggaatgcagttgatctcactgatatttggtaataactatataaactatggagtcttcacagctgaaagaaaataaaaaatcatcgatgaaataaaagttcaatgtaccatggatcatcatatcaacggcaaccacaggacagtgcggttgatccattgatgtggaccagctaacctatataaccatccttacacagatggaccactacaagattgaggccttggcaatggtaatagacactcgtttatccgagtgacatttgtgggggagaaagcgagaggggctaaggcacttggcagaggagagagccccctgctacggcaactcttgccagcctcataatatcggtactgtgcaacttggcaccacccacatggcaatatggcacggcaaaactgctttctgaaaccaggtgcaggttccctagctcaatgtgcctgtgcaaggcaactaaccttcttgtggccgggcacctgtgtacgtgtcactgtcctaaatggggagttctgcaaattgcaattcctatggttctaaataagtagaggttttaatgatttgatgagtgcatctacttatctagatttttttccccttcaaaacagtaggcatcccagaaaagtaggtgaaagcaacaaagtataggagcgcattactccaatcaaagcagatgatcatgttatactctagaaaaaaaaggcaaatatttttttttagtcggcaagaagttatccaaaagcataggtgggatctatgcttccagtgttgacacagtaaagttttctctgttccaaaaggtgaaaaaggatacaaaacgtttctaactcaagcacatacggaagcaagtgaaatagtagatggttggagctatcagtactagctttgaaagaagagcaaatttcagcatgcaaaacatcctacagtactgtttctcttgtataaccaaattattccgcatagagtgctaatctaacactacaaaagcaaatttaatgttactacagactgccagtcacagaacagacaaggtagtaatcagctgctgtttaccatctactccctccatcccattttaagtgcaactataagttttcgtgcccaactttgatcatccgtcttatttgaactttttttataattagtatttttcttgttatgagatgataaaacatgaatagtactttatgcgtaacttatgcttttaaatttttcaaaaaaaaaatcaaataagacggacgattaaagttgggcacggaaaatcatggctacacttaaaatgggacggagggagtatcttttaagcaatatatttccacccgtttgtctctattactagcactcaccacttaagggtaaccaaaaccataaacccataatccattcaaatactatatggtaatactacctccgtttcagcttataagactttctagcattacttacattcatatagatgctaatgaatctagacacacacatacatatagatttattaacatatatatgaatgtgggcaatgatagaaagtattataaaggaaagacaatagaaaatatgagtaaatcgaacacatgagacatacctaaatgagatccttttccctgcaggaggagaatgtgcatgtccagtttcacagaagaaagcatatgaatgtcgagagggttcatccgcctctgaacaacacctctacaccagtatactttctaaaatcacaaaaaccacatggagttaatcaaacaaaataaacgatttctgaacgagctttgagagagatacagcaatcagatatgctaacaccatatgaacatcgctaattttaatgtaataaaataatcaaaattagaatggattataagatatacatgcaatttgataatgtctaggaagtacaggaatctacttggcccataatgagaaggcccatgttcccctggctgtaccactaccacctttcaacaggtaaatgcggctccagaatcaacatgtacactaaaggacaatgctgtccattataaatactgaaaggatgctccacagaaatgattgtgtttcctctgaatatttttgatagctgcgagagctggcttcctagatgtacggccccaccttgatctcttcgttactctgattcctcactggtaacacttataatcctagctaggtcttggacaatctctgacattgatggtctgaattctggttccggctgcataagaaatttcagatcattcatcaatcacatgatttttaaatccatctcatatggctgttctcagaaaagaaaaacaacacaagcagagcagagcatagtgaacagataaacaagtatattacctgaatgtgatttaagtatcaaaatgactaaacaaattaatttgtgatataataacttggatataaaattgcagaatgcatttgacctcaataatgaagtaaaattatgcaatgggctaataggaaatttagatagttgatgcttttagcctaattaaacagctctctatagaaaattctggcataaaatcctgatagagatgcttaaggaagtgacacatgtactatcttatattatgctagaaactagaaactacagtttagctcaaaagataatggaagtatttgattacccgaatacaacggctgatgatgtctgcaaaacgtgacagtactttctcagaacactctccttgaatagaaggatcaaccatctttgatatggactcaatgtcatgaaattgagaatcagcccatctaacaagatgttgttcagcacgaggacgagaactgcatattgtaacggaaaataagcaagcaaactagaaagttcagacaacatttggagacaattgatctaacacaattatgaaactaaaattaagaaatgcatattacggtgaatcactgacctgtcatatggtttacggccagtgagaagttctagcattaccacgccaaaactgtaaacatcacttcggtaggtaaaagtcccagcttcatggatttcaggagcttcataattcagcagtgccctcatgcgacctgacaactggaataaaagaacaccattctaagttaaaaccacagagaggacatccttgcagcaatggcttcattaggagatgcaatggggcaaccagaccagagatgtgaacgaacttgcttgtttctttgcttgcttaactgatatttgttaaagcccttaaatgaaccagctcctaaaaacatcagctaaaagcttcttaactgaaaataatcctaaccaaaagacaacaccttatgaacaaatcgagggaacaaccatcaatttcaggcctgaggcgagttctactgctgtggtggatgtgcatggtaggctggtagctggaaggcccaacataactaatctaaaacttaagataaataaaattttaacccccttctttcaatagtctttcctgcgatagtaaatatgtggataaggctgctctagtttggaaggaagttgtagcactggacctagtagctgtcatgccctgagagctgcttaggtgcttgaatactggattgttactcgtatgcagtcaaattataaagagtagtattcacaacactacagatagtcaggtactttaattaaattatcacaaaactacatatttaaggtgttgtatcacaaaactacagatttaagtatttaacacacggtttatcacaaaactacagatttaaggccaaatatcacaaaactacagctttaatactagagttatcacgaaactacatattttacaatttaaatccctaccactactatcatgttaagagttataaatgttatagttttgtacttcctccgtttcatattataagactttctaacattgcccacattcatatatatgttaatgaatctagacatatatgtgtgcctagattcattaacatctatatgaatatgggtaatgctaaaaagtcttataacctgaaacggaggtagtacttaacttgctacaaaacatgtagtttgtgatattttattactaaatatgtagtttggtggtcttccatcttaaatctctagttctttgataaattcggtcctaaatctgtagttttgtgatgcaccgccttaaatctatagttttgtgatagtttgatcaaagtatatgtagttttctgaaatttactcttcttaattggacttcaggaattttaggaaatgtatcagaactgcttgcgacggaaaagccgaagtatcacaaccacaaggttggtgtacaacactagatgttacctgtgtaacagaacctgacagcgtcaattctgccagtccacattcagcgacacgtactgagaatccattaccaaggagcacattggctggctcaaaattctggtgcactactggaggttcacagctctcatgtagatagctgaaagaagaatataagtacaaaagctaccccatgaaaaactaaattaaataagcacaagttcatggtaattatattgaaccgcgatacagcttggtaacttactctaaggcctttgctgcaccaagagcaacttggaggcgagcattccatgatagtgcaccatccaattcctccccttcatgtagtacatcatgcagtgtttttctactgaaatgattataaacaagtaacctctgaccatattctgcacagtatccaacaagctcgaggatgttgggatgcctaatatctgatacacttgcaaccagttctagaaattcatctaccggtattctatcattggcgttatcaatcttcataacttccaagaactgcataggataaaggaagattagtatagcatttcaataatcataaaattccatttaaatgaagcagtattttgtaaacataccctgccttcaggaagttctgccagatatacttttcccaacctactctctcttatcaaatttccctcttcaaaactatttgtatattgctgaagtgatgcaacagaaaaggatgttgcagatgtcgagggacctgtcctaggtggagtactaactcttttctctggcttaacaatgggatttacaatcactttttcaacaggtggtggtggtggcggcggcggcggcggccgcggcggtggcggtggtggtgtcggaggaggaggaggaggtggtggtggtggaggcggcggcggcggaggtgtagaagcaaaaatttctgtttctgatcgctgcaagttaattacatgttcttttctcttttcaggaggcttctcgagagcagctgccagcaattgaatagttattttatacatctgaacttaaaaatgtgaatagtattacagtactaaaagacctgatagatcagatttacaagcatctatacctggtaccgccaaatttatttcacgaacctgcctccgttcaggaacctctgttgatcctgttaatagaacatcaatatgctgtgatataaaacaaataaaatataatcagaaatatattacagaatatataaattaattgttgaccttttttggcatcattccttgactgcactgaagcttgcttaactttcggctcttcaaccctctgatgaaccctccccacctgacttgttgtataatcacgtcttgactgtctctcttggtacttggacaggcaaaatattaccagcagcactgtaactataaacaggacaatagctagaagaacatatccaacaatcctgagggttgaagacttatgtttcctagatgatggagagctgctgtctcgagcagtagatccaccagaagaattagagggcgaactagatggcgaaggagttccagaagatgaaggtgacgatggtgtttgtgttggtgtagagcctgtaggtgttgaagagggtgatgcagaaggagctatgctggtattaaatgggttcccatcctttctgtagacaaaaacaatgaattactcaataagttaccttacatataattacatatggcaaaagtatatagtagagagaatttttatgtaggaataccaagtactatgtgaattgcatcaataaatttgaaatatgtaagaaaaaggattctcacttgaagtttggcacattcagcaactttggaggaaccggtccagaaaacaaattattctctatatttctgtttcaggtaaatatattatcagaaacaagtgtagatatttcatatttgtatgcataacagcattctaagaaaaaggatgatctggattagacatacataacaaattggatttaaattactgtttgacttgtgaatgtctatgataagataaaagctaaatcacttacatcacctgttcttttttctaactagtacagctttgttaaaacctaaaagtcccggttctggtcatgactacatggtacattatacttctgcaaacaaatgtatgactgccatgtactttgtgaaaggatgtcaagtttctacaaccttatcaaattcaatgtgactgttgaataatagagaactttgtgtctgctaacatattgttgcatgttacttcaaaataatgacaaagtgcaggataatcataatttatactatgacatctctaaagtagaccagaagaaaatgtctgttaagcagatcaattttataaatcaacacataactgagaatacaattgctgattgtccaatttatacataatggtgtactaataaaagtgaatcagtaatatgatgacagaatagagagtgtgggaatacaaatctttgagggggagatcctgcaagacatcaagggttccggatagttggttgtcttgcatgtgcctgtaaaataacaaggcatgaaaataagtaaaaatgatagggaaaaaactatataagaaaatacttgtagacttacaatgtagtcaatgatgacaggcttcccagagaaggtggtaatgaaccactgaagttattggatgaaatatcactgtggtcaaatgctagatgttatgaacgagttaacagttcaccccttgcctgccaaccctctcgggtcttggggaaaatgaagatatgatatactctcaggtgcatgagcaagtgcacatgaagagtaagaataagcaaaatgaaaaggagaggaaaatgaggtatcttacaaatttacaaggccagtaagggaaccaaaagcatctggcagtttcccgtcgagatgattatcatttagagacctacaaaaagacagatcagaaaaaaaatagtacagcaacctctctgcttaggaacagaaataggacaatagtcatacatgtctgttaaactctgaagcattgatagtgacgtcggaatgcttccagtgagctggttatcagacataaaactgcaccagcaaggaacataaggcatctcatcactcaatcacaagagctaaaaaaattccagaagaggaagaatagcacatacaaatgctgcagtgtaacaggtagatcttctggtatagttccaccaatattgttgttgctaagatttctacaatgaaagaaaagtaaatagtcacaaaacctgaccaggatacatacgaaaacaacataacttctgccaatatataagtacagactttgaatttcctattgatctattaattactatgcatgtataattagatgacatgacgatcaaggatcaatcatgggcaaagagaataaaattaacagtaatactcttacatagtggttattgaagtgaagttccccaggctgcctaactgtccttccaaatttgcagcattgaaaattctacaaacaatgagttgataaaagcacaaaatataaacactcgaccagataaaggaaatgcaaatgtacaatggacgtacattgaatctatatttgagccaatacatacaacgccctgccaaccatcaccacaggggtcaccaccattcgcagtccatttaggaagagccggtgatccaagtgcaacatacagtccatttatagcagcaactgcccataaatcaagcaaaaacagtcattagtaacaaacataattatccctgacatggattcacaccaaatcaacaccattttaaggtacttaatgaaatgaacctacatagtaagtagagtgcagagtgtgcaaatgggccagttaattcaggtaaaacagaacccagcatttcaccaaaaaccaagggtgagagtggaaattagtcatcatatcaccttcagccgactttttacaactaagacccctttttatgcaaacagtttgaaaggaactttttaattaaagattcatgtaagcgagagtaataataagaccatttctcattctaccacaactagcctaactaaatcatccatcactttatccatcaaccattgtcgtcaataatgacgattactaatccaaagagaacagttcacataacaatcctaaaacatcccttcagaccgaaaatagcagctcgattgcagcatttaaccacttcatttgcttccacaagcaaaagcacacgaaaattcaaccgccgcatcaagtccagaagaagaagtaccgcaagatatcccctgccaatccgcacaatcaaattgaatcgatcgacccaacctaaaccccccacacgtttctcaccacccgcccaatctctagtgcacagtacagcactgcatcgaaatcaatccccaccttgacctcgcttccaccgacaaatcccatgttcaccccgaacagtacttagctcgaatcatcgcctccgcaaacagtgcaacgaccaacggccaccaaccaaaagctagtgcaacacgtacgagcaaagcatccaagcacgaagcgcgagcgcggagcacttaccatcggcggcgacggtggccgcgagcgcccgccggggcaatgccgccgcggcgatcagcagcagcagcggcagcacgagcaccgccgcgggagcccctctccggaagcagcacctccctcccgctgccatccgcatcgacgcaaactctctctctctctctcccctccagcaattaatcagcgcggcctccgccgaagcagcatcagccagatcaacccgaagcgatcgcggaagaagaaggaaccaaaccccgcgttcgcagatctagcgttcgctcgctcgcgcgctcgcgagagagagatgccgtgccgtgctccgcaccaccgccgccaccacggggctcgcttcccggagcacgccgccgccgccgccgccgcagaggcttgtgcttttggtgggcttctagtagaatctagctgtaaaactgcagtctccagaggagagagagagagagtgagagagagagagagaggagagagaggagagtgagagtggcggcgaagtgagagaagagaatgcgaggaggaggagcgtgggagtgagcaacgggcgtgaaaaggtagagagagagagggagagggagtgggtgagcggcgagcagcgaggggagaaagagagagagagaagaaaaggcgtttgcgagaaaggagaggagaaaaaatcgagcagaatagcaggggatatttgtacttgtgacttgtgagtacaaaattattcatctttctaaaaagtattattcattagcacataattaattaagtattattcgctccgtcctagtttactagccgttctagaaaggagatgacaaaatatggtattggaaaaataacctacatacccctacattaatcatttcaatgcttaagaattaacacaaaactagtactgcgtctgtcatttcgatatgtctgcaacaagtatagggaagaaaattaatagaagtactcatgctagtggctagcatgctagctgccccacagctaaacgaccttctttctgggaaataactctacaccccagcgacaactaaaccgggactgatagagtagtattaaaaaattaagaaaataaattaatatgatttttgaagtaacttttataaagaaaatttctataaaaatatactatttagtaagcatgtttagtggtttaaaaaacatgtaaaaaaagaaagatagagttaagaaagtgaacaaaggaaccgccatgtgtagtattttctccgtttcataaaaaaataaactagtatcgaatatgacatattttattaatacgaatcgatacttttcggtttcctagtattaggagtacattatttttttttatggaacgcgagtagtgcgagtgttctgcacgctgcgaggcattcagtgcaggggaggggtcgtgtggggcccatgatgacgtgggtctcggctgggctggattgggagggtgtgtggggccagcgctgacgtggagctctcgtggggtgggctcctggattcgtttttcatttggcgttttggctttttgtccctgggaagagttgtttgggcacacgaaaaaggaagagattgcagctttggatgccgttatgtatatccatgtacgtttgcaactttgcattgcacccaaatgtcttgtgcttgttgtgcatgccttcacgaaaggcacttccttttcaaaacttttgaacaaagtagctagaaaaaaagtgtgttgctcaaaggtggtttagatattttgtgttgaggattgatatgaatttgtgatacaaaaggatatacttagcccatcgatccacctgtaactcgaatttatcgaaacatgattctaattttggtagtaacaatttaacaaacatcctacaagagtattataatataattaacctatcactcagtgacgaacacacccattaggcagggtgggtcggccggcccaactacgatctgtgtcgtcccacaccccgaaaccttattttagtcctatttccaacattagtcattagtctactattgaataatcagataaatcaagtattttaagtaggaacaaaaacatttatgaaaattcgtgtataagtaataccattttgatcgtttctgattttggccgtacataaaattctattttctttctatttctttagtgcataatacagtctacagtaaataggtaaatatattaaaaaaatccattttactcacttgaactattttgacgaagcacttaaacccctaaataatttttcatctcgttttatacccccgaactattgaaagtggttccccttgttgtctaacagcatttctcattttcttttatctctctacatataagtcatatacgtttgttcgactaccaatcctcgttgttaactttctcgatgttcgtgccgtgcattgttgcgccaatgccgtgaaccagcgactaagatttgtgtgtgttgtgccatcacctaattagggctagctctaccgtcccatctatattttaaacatgcgtccatcactgctatatcacttgatatcaattaaactccacgagaagaaggagagctatcctcacagaaagaaagagagagggagagaaagaagaactataaagcaaaggaacatgacaggagctaggagacaccgaatttcattgccttagccgtcaagcacctggcaattttccaacaaaccaaagcgtcaaaaacctaataaaaccattgattcgacaatgacatccatgccaagtcacaatcttgtccttcaaaaaaagaggaagcttgaagcacataaaacccatgcttttagtgagagcatcacttggaaggggacaagttaagagcaatccttatccttcaaacctgaggcctgcaaatcaaatggccccacgtcaattagccagccgccatgacagtatatatacttgttgaaagcgcattgggtcaatataatggtgattggagaatgcaatagttaattaatgacagtacttatcacttactcatatatatctcgtgtgtcctgggaagcaaacaaaacaatatttgctatgtcaattaagatctatcattatgttgattattactgccacgagggtgaaaggaagctctctctttcatgttgctcaggttaattttggtttactctctgacagattagtttagtttgaccttaacagatcaattattgtcgaataatacgtaaatacgatagcatgtagtggtgaaaacggatcccatccactttgaatccatccgaaacaaaggatattggtacgggtgtggttaatgggcgatcgatcctctatacactctctctcccccttcctcctccccttcttctcttcctactacaccatataacttttttaaaaaaaaacaaagttagaaaaaattatgtatagaaatactatataaaaaaatatttgaattcaaattcaaatttgaaacgggtacataaacttttgacttataaactttaggtctataaactaatatttgaattcaaattcaaacttaaatcgggtatgtaaacttttgacttataaactttgggtctataaactttaggtgtataatttttagatgtatagaaatactatatataaaaaatatttgaattcaaattcaaatttgaatcggatatataaacttgacttgtaaactttgggtctctaaactttaggtgcataaactttagatgtgaaaacttgatgtgtacaaactttaggtgtataaatttactaaaatagtgaagtaatgcggtgcaaaaaaggaaaccacatggaggagggggtgatcgatgtggggagggggactgatcgcttggagcgatcgatcgccccttaggactttcgtattggtacgggttttaagaaatctaacggatatagttgcaaatacagatagtataatgtggatatggatgcaaacgtggtatctctaaaattcaacggatgtgaattatccgatatatctatcagattatctaataagccgtttgttgaataatccagaattatcaatctatgtaatcactctatccattgcatgtgacatgagccagactatccaatgatctgattcatcaattaacctagattttttagtttggggctttcatcatctcatttcacacttgcattgctgtatttttatattatgtatacattgtatacatattatttagcacttaagtatataattattacgataggtcatttattgatcattttattgttgtcccattgctaactcgatgttatattgattgcaataatgtaacgtccaacagatttaatctgtttctaaattgagtccacaccatttctgacatccgaaaaaatctgccttatatccatatccgctaaaaatatacttaaccgtcccataaaaaaccaacctagtactggatgtgacacatccagatttattgtactagaatattgtactagaatatgtcacatctagttctagatttatttttctgggacggatggagtatggttcaagatatagtatacctatatcttatccgttttcatccctaatagaatcatagtatgccggcgttaattgctgggttcattcaaagagatctttcggtgcatcatgggaagttgggtataccgaactaagctaagtgcatttaaacaggatggacaaacaaaaacagacgagatcaactttagccacaaggatcagagggaatgcttagcatcaccaccaagttgtcatgatgatttcaacgattcgtcccgtcatgggcctgctgctgacgtcactatcctaacctaacacgtcagactaccaaaacgggtcaatgattaacgagaattcgatccattgattcattatcgtaccaccaagagaaacgattacaccctcctaattatataatcattatctgaccgggaatgaaaatggtcatacacgatgtcatatctagtgatttttttcatatttatcaatttatttatttagcggtgatattaatatgattctaacagaaacttaaaaaatcaaaattttataggactataataaaattcagtcgaaaacggtacgaccagttatataaatgatactcgatcaccggaaatttacatcaccgtatgtccgtttgtacttctagtagagaccaccggaaaagcactcctgataattcaggagtatagcagtttatgtagctagtagaaagattctagtcaagctaaacaatggaaaagggggtgtaaaaggtgagaacaaaaggaggaaaaaggccggcataaaacagaagagaacctactctcctttcggctacttgactttctaggaccagataattcttggatagctactttgtatcctagaggatactatagcatttattatgtagtactccattcattccaaaataaaccaacatcttataagatgtggcacatcctgatacaatgaatctggacataatcatacaagatgtgtcgtattcggtacgagattgatttatttaactgcccactgaaatggaggttcataaaatccgagttggcaaaagtaatcgtataaaaaaaaattactgtgaaagtagatcagtcatctgaaccaaaggagttgcaatgtacaaattgctaaatgaaattctacattttttacagaagttgtatgataagttcaccggaccatagctcattattatcctgaagaactgaacaactgaagtggccaagttcaggaatttttccctagacaaattccattggatgggccttagcttagacagattccattggatgggcccagctacgaatttttcgtatacgcaacaattttttttagctcaattatacacaattgagataggatgtgaatagcatactagctagctaggcccacaaccactagttgttcagcaagcaatatcatcaaacaatgtctgtaaatctgtaaataactctcatgtggtacaaaattaactccaaagtgtaaattatgtactccctccgtttcaggttataaaacgttttaactttggtcaaagtcaaactattttaaaacgtttggttaaagtcaaactattttaagtttgactaattttatagaaaaagtagtaatatttttaacccaagacaaatatattataaaaaattattcaattatagatttaatgaaactatgctggtgttgtaaatattactattttttttctatagagttagttaaatttatagtagtttgactttgactaaagccaaaacatcttataatctgaaacggagggagtaactgaaaagtaatctgccaagcaggtgaagaaagggagcatctatgatgctcaattgttgatcacgtatagaagtcattagaagaatgaattcagtcatttgctgaccatgcatcagacctaaaattcaaccgtacagtacagatctctcctcgctcccctaactgtaaaacctcttctacttgactacttcccaaattttctctaatttcaatatcgttttcttttctgaactgccaatttcaatctctttagtgaagttcaaatattccgatggcctttttctttaaaaaaaacctgtttctgaacggcttcgaatattccgactgaagagcaaatccgatgattttttttccttcccaatcctatcaaataaattacgaataatttcttcctccacctatcttatagtactgcagttagtaattctccatacacaacattggtagtaccccatccgttttagattataagtcattttaactttagtgaaaatcaaacaactttatgtttgactaagtttatagacaaatataatattatttatttacaacatcaaattagtttcattaaatcaataatcgaatatgttttcataatatgtttgtcttggattaaaaaatattttttctataaacctgatcaaacttgatataatttgaatttaaccaaaagtcaaaaacaacttgtaatcagaaacgcaggagtatagatcacaaactgccagtgttacaaatttatcacaaattcgagcagttccatgcacgttgttagttacacgtatccctcttgcgtttcgcgccaagcgtgccaagaagatcacgcctgaccaccgcccgagaagcggcgccgtcgttcgacgtctccggcgccgccgccgccgccgggaagaaagcgccgtcgtcgtcgacggctgcggctacctcctcctcttccttaacgactgcatcgtgatgatgcgggccactgctaggcgcatcgcaacagtagccgccgccggccgccggcttgtactccggcggcgcgccgtcgccgtcgccgtcgccatccagggcggcgccgccgcgccgccgcgccagcttggcctcccagcgagcgcggaccgccgcgaggacgccggccagctcaacgccgtcgccgacgccctgggcgacgaggtcgccgtggacctcgccgacgacgtggtccatgacggcggtgtacaccgcggcgacgtcgtcgctgtccttcttcttagccatggcggcgatcgacgcgcgtacgtatgtgtacgtatatatacgcccctgtagagagtatttatacctcgagatataccgttatattatgctagtaaatcgtattcggatgggataacgatttttacgcgtacgtgaaacgtgataatcacgtatactacgtttttacacaaaaataaataataaataaatatacaaataatcagtatccaaccaatttgttgttgggcttgggcctcggcccaggaagagacagatttgcacgggacacgtgtcatactcttataggctggacatcgaggaaggcgtctataaaacacggggcgcttcagaaccctaaacccatcagtcccacctgtctctcgccgccgccgcagcacaagcgcattcagatctcggtcgcttggttttccttcttgatttcctctccgagtggtaattgcttccgtgtttttctctcttttttttttctcgttgaacgattgatttgcttttgcttccattttgtttgtttgaagatttcaattcatcgcatcgttgatatagtttttgaatcgtgtttgggatgcaaatgatttggtggtgagaataatagggctctatattatgagtcaacagcaggcgccgtttcaatggtgccctgtctgccgcttggagcccagatcgatgcctaagccaggagaagattgtttggagatccatcttctttagttccaagccacaatacctggccacaaacccaaatcatcccccaatcgaaaacatcgccttcttttcttcagttcttgctgtttttttgtatggtgatttgtatgttttggacggctctcagacgaacgggtgctctgccgatctattccatgggcgagccaccctttgcagaagtgccgagagagacgcaggccgctaacacgattgggtgtttcctttctagatccatccaaatttcaagcggaaatattgtatctgtatcccatagatctgtccggtttttcattaattcgctcgctttggtgtttcaatcgattgcttgtttttgctgtcagtcactgcggatcgaaaaaacttgtgcaactgagggactaatctaggcggatgatttctgtaaaactctaatggacaatgggtactccatataaaatatgcccatcttaaaaatatttcttgttgatcggatggacacttagggagttagggtgcgttcgttccatggacaatgatgagtgagatagcacatcgatgcgttttttgcaatttttttttaaaaaatcatattaatctatttttacactttaaagtagttaatacttaattaatcatattctaatagcttatcttttttttgcatatctttccaatcttctcgatattcgaactcacccttagcatggacgagtactgtacacggctccatagttcatcaagcgaatgaaacaattctttattctcgcgttaaaccattattaaagttcaaacttgaaatctgtaagttcgttaaaaaaactgaaatctctaagcgttaaccctattttctattttcgtaatagtagtaactaaagcaaggcattgtttagatcgtctttcacctgccattgtctgttgatttgaggttgtcctgccacttttctgtgtcaacattactcggatcattctacggtttcatttgtggatttgagattatcagagatcgacacaagagaagaatccactgaattccaaagacgagtaaggtgcaactttttgcagtaaaacacatcaggcacaacagaccacagttccagaacagcagttgacagatacaaaacaactgaaggtaaatcaacagtaaaatgagcgaaacaccaaagctaacggaacgtttattcacacaatggtgttcttatctgataaggggaccaaactgtcatgacagtgcggtaacttcagttatcttaacacaaacagcagacagcatgagagcaacacaacatcataaagttcttatcagacatgtgtcatagtaacccaacataatcacacaatggacaacctttcagctcaccacaccataatgatacattatgggagtagcattttatatgtacatgtctagaagttcatcctacaaaggggggcagcagaagaagaaatagacaagatgaaaatgagaaatggtgttcgccattggacgtgatgagatgaaccaagtcggcgtatgatacacctctttctttagatcggcgggatgttcgaaaacgagaagcccttgtaccctttgtaagcatagtaggcaattcttgtgtagtagaacccagggatgaacatcacaatacccagaatcatgaagaagattcctgttccaacaaaagggaaatggcttcaggtaaagaaagaataaagtttcaacagcaaaggttctatcttctatgcaaggggaaccctacctattgtatgctaaacaaatgttatgttaccaaacataaaacttgatgactgaatcactttgtgcccacccacttaaaaatgttaaaagtttttttagcctataaagttgtcaaactagagaacccattcgaatcttaaacactactccagcagtcaagccctgttgcttccagtgattgctatctggagcttttggatataaaatgccagtatattacaaaaacttgatacatgaatgaatgtaattgacaacaaactagtagcattaaaataaatgtatgttctacgaactgtcaccaaattgcaatgcatacataaagtacattatttcccccaattgccacccagctgtagtaaaatgcatgtggttgaccaagtcaaaatcaaatgagaataccagaagtaaattactaataataataaatttcctctgagaaattaccaaaatggatgattgcgcagtcaaacaataacccccttaatttcatcctcacaacccaatgcactgaagccaaaccacaccccccaagctagaatcccgcaagatctctactaccacagcatcaattggggggaaattgtatggaagcccaggccctagacgcgcgaattaagaggagggcgctcaccgtgcgcgcggtcgccgccgacgttgttggcggccatgaggacgccaccgatggcgccgagcgcgccgaacgcgaggagcgcggccgcgaaggcgatctccttgacgggcgcgccgcgggggccccccacggcgccgccgacgaggtcgtcctcgtcggagatggagaaggcgtggtccacgtacgccatagctcccccccaccaccacacctccgctccgccccccggatccgatccgcccgcacctggcgcttgccaacgcggcggctgctacgcctcctcctcgcctcctcgccgccgccgccgccgcgccgagggtttggtcgcgtgggtgtgggtagggttggatggatgtggagagagagagattgatgagagagaaaaagggtgaggaggtggatgcgggtacaagcaaggtggaggagaagacgagaggaggagggcgagaaaacaagcggcggctttggtgttggtggacgtcgtgtgtgtacgggtcaacctgcctggttgggctgtggccagtggatgctgggcctatatttttcggcccatgaaggaatatatttgggccctggttgggctagattgttcggcctacgaggaaaatatttgggcgttgtgttcttttttttctaagttcatttcttggctcctcatgacgttaagtttgaatggtgttcttgaacgacaatatcagttataacgtgctcctcaacttgtaaaactggtgtaattgaggttctagagcagtattgtactagattgtggttaacatggataattgaccatgtttaacctggcggagccaacaacaaaccccacatgtaaacggccggcgctttcctcttcctctcttcccatctcccctctcttttccccatattctccaagggggtgccctgcggtctgcaccaaagacccaatccatggccagttgttgtagtacattgggttgcatacagctaaggcacttggtcggtgccttggcggacttctcggtgaggtcgaaaatgggcatgatggggagtgtcggcgcgaaccatgcaacgaaggtgaagaactcgcacatggggcaccaccaggacgtgctggccggcccactcctccgacgatgtgcagaggtgaatgagaaggtagatggccccgcccatggactccccaaacaagaagcctaacggctttcacgtgctccgcccgtaacttgatgaagcggaagaaggtgagaaggtcggctatcattaaatcgagctcagggacgaacaagcggagccccctagctcctctcccatcggccgatgcccttcttcccgccacgtgctaccctttactgtatcggttgtcgctttggagaagatggggaggataggtgaagagagatggaagaagacttagccactgacatgtgggtcccatgctaactcggctgggttgactgtattcaactcaccatgttagctaaaacctgacaaaatactgtcctaggacctcgagtgatccgattttataagttgaggtaaacgttacatctggtgttacaattcaagcatgtgattcaaactcgacgtcaagataagagacctaatgtgaacttattccttttccttttcaaccatgtctagcatggcctgctatgctagcctgccaggagcagtttggtctgtcacggcaaggctgcaatatagttggtattctgagtatttgctttcgtatttcttttctttagaagatagggaattattaatacaatacatttgcttcaaacatgcatcgtcgtgggagggccctaggcattacaatatttccattatgatgtagccatgtcattaggtggtgcttggacacaataacttgcacacaataagatgtaataaacctaagatacctagaaagtgcatggtttatacttcttatttgtcctaactaaagtacaatgagagcaaagctagctctcaagtgcatgtttgcttcattttctctttgaaaataaaaatgaaaaggtaaaaccagcatcattattattggtgctaggtgtgtaagaatgtagaactagtaaaaggttgatggtgtagtctatagtgggcatgcaagaaaaggaagtaaaaaaagggaggccgcaaagggaaatggctttacttattagccacggcaaaaattgttgctagctagctgccctcttgcatatgcctcttcgcagaaaatgtacaaaaataccatattaattgggtggggggcactcttccgccccataaaaaaaatctggtataagatatgatattgtctgatacattatagtaatattaattataaatctagattagctgtttatctaaattcataatgatatatcgtattatatttgttttttatagaacgagataactatttatctaaattcataggatacatcatgtcttgtattatatttacttttttttatggagagtacatgcgtgcgtgcatacgcgagtgggcgtccaattaatactacgtgtgctgtttgatcaagctgaactgaagcacattaaacctcaactacgcgcccacgtaggccataaatgtgaagacataatgtaggtgatggtcgtctgaactgttgtactccatgttcttacacacatttatagataaaccgtgaaaaagaaaaagacaaagcaatttttattgacaataactttatacctatattaatatcagaaatttaaaagccaattctaaaaaatagaccacaattaaaaaatatatatccaaaaatcaacttcagaaattaagtttcaagtttaaattttatctgtgactgtggttgataaactaccaaatgatgagaggcttagaagataggagaatcaatattttatctttataaaaatatgagaaaagagaatatcgtgttaattccgagacatgaagtttatagctggttgaagattgaacccgagatcttgaggttgaaatcacacattacttaccactgtactatcaagtgcatctctaattaaccttcttatgtgtgcatatgaaactattgagaatatatttgacgacaaactattagccacagtttaattagcaataaaaacttctattaaaaaataaaaatacaccttgcaatttaactaaaacaacttttatataatcatgatcagatggaccatgtggacttaaatggcagcatttttagggacatatatgatggggttggaagcctgccgctcatcttttctgccacccgctagcttattgtccagggagaaatgcagggacagcagcagtactgttagttcaccatggacagtatcattgaatcccctcttgcaaattgcaatggcccggccccacacacacaaaattttcagatctgagtggcattaaccatgcagctttcctccccagatctggagtagtatgttctgccactgctgcatgcctcctctcctctcctctgcatggattgctctctgcctcatgcatatatgcatccctttttaggtatcaaaaggaccagccaggtacaccaaggggggggtcaccctttggaagctctgcacagtgcacactctcctttcccctccagccattacctgctctctatctccctctcaatcagctgaccctgcattccctattagcatctccggacgactgtgtcgatatctcttgatattaacgaagttattacggacgtcccgctgccgacgggtatgtacgtcggttaccactgaaaaaataaatagtcgtaaaagcgagcatccggtcaaatctaggacctgaatccggatggattgattccaccaaaagaaatctaactagttgagttacgctcatttcgcaccatgcatctactagtatttaactaataagcatgcaacattcatgaatttgcagagtgagagaaagggaggtattttagattatttactgaattattaaaaaataataatcaattttcgattttttcagattatttacttcaaattaacttaaaataagcgatctaagcaatagtacacgtttcgaaaaattcgttttctcaaaaaagttatcttctaatacattgccaaggtcatttgtttttaagttatttgttaagttaatttttaaaatatttaaaacattccatatataaaataagtagataatctactagaataatccactcaataacctaaatcaaatggtgtcttagttggctttttttttagtttaagctctaagctagagccacacgcttgggatggagaaattattttttgagaaattgaactaaatccctgtaaaattcccgaaaggaggtctcaaaatgaagtaaggaaagaaataatattgctcaacttttgcacatacagtatatattatgcaatgcaagcacaatattccttgtcaaagtaagtaatggcatgatcaatcgagtgatgagtgatgaccattcaattggtacctgaattagctgaacatccagtcagctagctagctagggggtaatgatataataatgaactacatttacagtttgttattcaaataaccccctgtagtaaaaaaactagattaaagtaagctaattaagctaaactaggagtaattaattactaaactaaaccgtctctcgttgcaagcaaccaacaccactccatggccatgcacgtatgtacgtatagccagagtattttaggccactcgccatggacagcttcaagctcagacgagaccaacaatggtggatacatggatcagcccacgacgtgcacgccgatcttcttgccgtccagcggcggccggcacggcaccggccgccgtgggacgaacaccttggcgagatcgtccggcacggcgacgaacgccgccgccgccggcgccctcccgccgcggcgccgcccgcagcagtagcagctgcggctaaagcgagcgtccttcttcctcctcttggcggctggcctcggcggcttcctcggcgccggcgggcacaccgacggcgcccgcagcacgctcgccgccgccgtcggcgtgctgcacagcaccacctcctcgaactccggcatctccgccgccgccgccgccgccgtggtgcggatcggcgggagctgagcggacagcaggtcgagctcgaggcccatgtgtgtgtcacacaagatcgaagagaagcttagataggaggcaagaagaagcaaggtagggttgctcgagctctacttaagtagctcgccgccatggcgagtgagcgatggaggagggaagcagcggcaatggtggggtaaagaggggtggatggatgcggggagcaggcgtggagaggatggcagtgatgatgatggcaaaggtggcgatccagagagagagagagagttctatggagacagactgcaggcaggtgcaaaaggttagagagagaagagagagggggagctagagatagaggtgatactgatgattgtgagaggaatgaagtggggggctggatgatgatggtgattaagctttgggctttgggggtgatcagatttaagctgtctaggttggagtgtgttaataattaggttttgttagtttagtagtactcagctttaaactaagttggatcttgccttaattaagtcaccaatgtagggtgaatatgtgaaattaagtgtgtgatccagatcatgagtatagtgcatttttgtgagaccatgaaagtttaagggtgtgcttgagaagaggagaaaggaagagcctaatatgtcattttttaaaattgtaaaatggactaatatgattttagaaacaacttttctataatattatactgtttaacagtccgagaagcgtgcaaacggataacaagatatttcttctgcaaacgaatatagcccgattgtccctcgagggatgtcctcttgttttatatatcataaatctaaaaatatttaataagatgaattaatataacatatatcactccacgatcatacatgtttaatttcaactaatacaagttaaaagaaacaataagttcgagtgtcaattgtatgtactagttcatggtaagaccacccgaatcagcagtcgatccaatgtatggcgaccttgagcagttgcccgggttagttggcacggccaaaggacgggaaaattgcattatcagtgtttgacgatcccaacatctagccattttgtgaacgtttttatgctctatgaaatttctaggtccaccatgcctttaggctgtgttctcggccgctgttggctgtgaaacaagtcattagtactccgtttcaggttacaagacgtttcaactttagtcaaagtcaaactactttaagtttaactaaatttatagaaaatagtagtaactttttaacctaagacaaatttattataaaaatatattcaattattcatgtgatgaaactaatttagtattataaatattactatatttgtcagtaaacttaatcaaacttgaaacagtttgactcttaccaaagtcaaaacgtcatataacctgaaacggagggagtatatgattaattgagtacaaattattataaacttagaaaataagttcaattgagttttggaaagaaacttctacatacatagttttgtaaagaaaattgtttagcagtttagtaagcatgataatggataacaagaaagttaccactaccatttgctcaaatgaacagtccctaagtggaaaaaaaaactatggtttcatggcctatatatcgttattttctgattaagatgtagattctatctcgatttttttagtatgttttcaaaccgtcaaacactgtgtatcgtgtaaaaattttttatatagaaactactctacaatatcaaataaactaattttttattataataatgaaaacccgcgttgcctccattgtagcataatataaccacatgggcccggcaacgtattttctcaaccaattctctccctggaccactgtcaggtgtgggcccaatcccaaggctacgtagggccatatccgaattatttttatgtacatgccggccgtcacgcatgaagcacgcgcaatatatatgtcgatactcgatacaatatgtcattttcccccataattaagatgataagtatagtatgttcaaagaaaatggtccggaaaaaaaatctaaaacaaacggttaacacagaattaatgagcaaaaccagattaattaatgcgtgtgtgttatattgttatatattagtatcatgctcctgtattttacaaacttactcccttagttttaaaatgtttgacaccgttgactttttaagtacgtgtttgaccattcgtcttattcaaaaaatttaagcaattatttattcttttcatatcatttgatttattgttaaatatactttcatgtacacatatagttttatatatttcataattttttttaataagacgaatggtcaaacatgtgttaaaaagtcaacggtgtcaaatattttgaaacggagggagtaatttgttttgaaaccaaattaaaattcggtgtgtggtggatccaagaaagccaaaacatttttcctattttgcgaggagaaaatccaaaacttgacttgcatttatgatcgatgttcgttattagttgcaacataaaaaaaatctgcgtgtcttgcaagcatgcgcgttcccggccaattaatatacttgaagaaaaatactctagaaattaatgctggtgtatggagcggctctgacaagcacgtgtagcgatatatgttactcatacattataaggtgattttaatgctttctgaacttataaagagtagtaggagtaaaatctccgtacgcatgttagggtctatttagcaaaatttttcgccatgtcatatcgaatatcaaatatttgaacaaatgtatagtgtattaaatataggaaaaaaactaattatacatattgtgtgtaaattgtgagacaaatcttttaagcctaattgctccatgatctaacaatgtggtgctatagtaaacatttgctaatgacgaattaattatgcttaataaattcgtcttgcaatttacatgcggaatctgtaatttgttttgttattagtctatgtttaatacttcaaatgtgtgcccgtatattcgatgtcacacgtcaaaacttttcacccctggatctaagcacaacattagtgatctaaaatcagataaaacatatcttattattgtgaaaatcagataggaggtttgttcaggttttaaagattcgtaatacatgattaaaagttttatccataatttttctatggcttatcatattttcaatgcatgagaacgtctcaaaaacccatattttgatcatttgatccggatgtttagagctactgctagctctatcaccacttcaccaggagatatcatgtccgtacaccgggagacacgcatacgcatatgctccatccagtgcgagatccaagaaccaaccatctactggagcagtacgtagtacgattgtgcttaattaatctaagcaccccgagttagatgcaatacgtcgatacgaccgatgctaatctgcctcgctattagcaacaggagtactgctgatcagtacgatctcgatcccggtaatggaaagcgaccaagtcatgtaactagtactacaagtaatattttcatggctgcttgcatgtaatgtaaaggggaaagggcaatgcagggagcacgcaaactaagcaccatgatttgggtgggagcacgggcatgtggcctacttattgtgtggctcggcgacatgcttagattactcctccgtaaacaaatgaaaaagggggtgttttttttttttaagaatagctactttagtccctaaagtttctctgtaggatctgtttagtccctaaccttataaatggtccaaagaaatccttaaactttatcataaggcctagaatagtctttgggtccaccaaaatcatcatatgaatatgctatatcatcattcatgcaaaatctatgatgaattgtccaatctacccttacatatatcataaaaaaaatataagggtgaattagacataaccataggaaaaaaatacttctttttttcacccttctgaggtatattttttctcttacatataccatatatttttgtaacttttttccttttgtttttttatcttcctatgcaaagggtaaattggacaaatcatatagattttgtatgggaaggtgacatggcatgtccatatggcgattctggtgggaccaagaactatattagcccacatgacaaatttaaaggacttgtttggataatatgaaagattaaggactaaaatgacccaggagcgaaactttagggactatattagctattctccctttttttccaagcatagcatgcattgccttgctatcttttcttttcttttttttggtgaaaggtcatatttgactccttaaagcattagggtgtgtttgagaaggaggggattgaggagattgggaagatacgtaaaacaagatgagccattagcacatgattaattgagtattaattattttaaacttcaaaaatggattaatatgattttttaaaataacttttctatagaaatttttttacaaaaaacacaccgtttagtagttcgggaagtgtgcgcgcggaaaacaaaactatctttctctctttctcctgcgctcaaacgcagccttataatcatcaaccctacatagatccaaagcaaggagatatactgaaagatgggcatgttactagaaaagttaccgaaatggcaagctagtgatagaactctaggcaaacattgtacgactagcaattgcactttgttcagtcaagagaaatactccatacatcagtattagaggcaaaacataggactaatttgctatggaacatcctagtttttatcatgtgccatatgtacttaccaggtatgtgtaatgaagctatcagctggatggtcagtttgccatgatggttactagccagattagcttaaatcctccaacaaacaagctactatcaaagtcaaaacaggcctataaaggattatataatttgcgccagaacatacctaaataaaagtacagcattcaagtacaaaatgtatgttgatcctgaaaaatatgagcagctctcaaaaatcaaaagcagtaacactaataaacctcccagtcatttagctcaaatttttagacatctccgtgtaatactttgaaagaagatgtgctcagtagcgtactatgatgcatgaatgcggccaagactggccacgggccaacccataggtactaattgacccactctagtccaaataaacgaactacatttcattttttgtgattctaaaagtgaaatttagttcatttagttgaactagtgtgggtaaaagagtatccacgggtcagcccacactcatccctagccaactagtgaagtgtatgtctaagttcctaatctttgtttacatcggcgtcaggcccaattcatgagtaagagaggatgaaacatctgtcggattggcttcaacctcagtatacagtcagcctaagaggtagcatggttagaagtcaaccttcaaaattatacaagcatctatgtgcaccaccactaatttcagagctgataattttggtcacttggacatgcacaatcacacaggtggaggtggaggtggaggtggagttgatccttcgttatctgtaaattgggccaaaggaaggtgattaaattggtaaaactaaaaagaaataatgttactgccggtgttctgataaacagcagcgaaggaaacaaaacatagaagcaaacatagttgctagagaacagatatgtttcaaatgtttacaacagctggctaaaatatagtgggtacctttctttcccggtaaacaccttgagatgtaagttttcaattcagttcggggaaccggtatgaactttccagcaaaagccaggggccaactgcatgaacaaggcaatagttagctcacagtaagcaagctacagtcaatcgttataatttatccatcccaaactaaagctgttttcttcgattgctatcagatcaatagttggaggaagaaaaggtcactaaataattttggaaaagtattaatcatccctgcaacagaagcaccacgttctacaaagtggacaagtatctcacctcacaaaaccaataccaacagaaacaagccaaagcttccaactgagtctcacagttgatgtaaatttcccaagaaactcaatgattattacctgagtatcagagatatgttagttaaattttatctgctccccgaactatttaatcagcatttgaaggtggattgagtatttccaccctttcatacctgcagcacgacagttatgctcactacagccaaaaaaagatggtttcttgaaaccccatcaaatatattcagttcatatggtttacgagaattgaactcgttaaacacctattgtaaaagaaatggagaagttaggatttttctcaagctgcaaaatggtgcacatctatgctatatatgaaaagaaaagataaccatttaacaaaaatcagtaacatgctttcaaaaggtgcaagaagcccaccgaagacaaattacctgacaaagcacaaatgtattaaatataaatgtatttttcactttattggcatgatcaagagtatcttgagtcaaatgcagaagatcccggcctctaaagttgagtgtcagaagaacagtaacttgaaagacagcctgtggttagaaaaaaaaattctcagcaactagccaagtaaaaaataattggattaacaatgcagaagcattatatgacaagtccgtcctacctgaatgaacaagtttctccacataatgttagtcacaagtggttctctgtgttaaatgtgaaagcatgttagaattttgttattcctttacaaatttaagacaatcaagaattatagtgagcacgggttggtttcaggtgtactaacttccgtccaacaggtggccgcttcataagttggtctgttggtggttcagtagccaatgcaagtgcaccaagtgtgtccataatgagattgacccaaagaagctaaatcaacaacaaacggaagtaaaacattcagccatgtgccgacgtgcaaatcaatacagttaagtatcttaatttcattttcactaacaatttccccttagcccatggtaaaattattttttcaaccccatctttatttacaggacatcttctaaatgtcccttcaacaaacttgattgatttaagatttaacatatcagaatacactagaaaacgtattcatgtcctaactggttttgcatcctaggtatgctttcaacaagacaccgccaaattccagattccaagtgaagccctcatgtgattaaagaatggtacagtgagcaagcaggatacagtccccaatagtagcaaaaaatgataatatactgaagtaaactccgtacagtgccacattgccactaaagtaacaagcacatactccatagttatttccattagccaatgtaatgattcagacacagcagcaagtggacaaactagttttattttgagggaatgcacataaaacttgtgcatcattgcattaagattgaaagaaacaaagttctcaaagaatccatcttcgcaactcccaaagcaaacagaccaacccaaaacaaaaaagagtttaaagcaacagagtttatctcgcaatatctttttgcggccttactacagagagcagtggccgaactagtcatggcaattcaggcatggctaacaatttgagttttaaactatcaataaacaaagttatactaatatggcatagtacatagcagtaactctaagagtattttcctctcaaagaaaattctaagagcattgtgttgttgcaaacctgaacggcgtttagaggaacatttcctgaagaaatagcagcaaccacattgattataagagccgcaacatttacagtaagctggaattgaataaacttttggatatttgcataaaccgaacgaccccagcggaccacctagaacgttacatatggataaatgttaaggcatttgttaaattaattgtgtaagattattaagctccaacttccctaacctttacaactgaagcaaaattgtcatccagaataattatatctgagctttctttagctacttctgttccttggatacccatagcaagaccaatgtctgcctaaattaggaggaataagagatcaaaattagaaatgtgcatcaacatgcatgatcgattgtcttcatctgattgaaataaaaccattatgtttatccttttatttgttcaaaacaaaattcccaattatgtatgtacctcatgcaatgcaggagcatcattcgttccatctccagtaacagcaacaacattgcctttctttttcagtgcttttactaggagaagtttgtcacttggagaagatcttcccatgacctacaatgcattgttgacatcaggttgcttcccctagaatgatcgagctaacagccagtacaagtactgaacatggtaatgtgtaaactcgaaagtatgtactccagatatatctgtcttactacatgaaataaatcgttaggcattctgcagcaatttctgcaaccgagctataggtttatggttccattttttgccaaaccaaaaaagcaagggaaaataacatacacaatgagcaatgaaccagcttaagaactaaaagcaccattataaggttacatcgataaacttggtacacactttaatatttttgcaagcacaaatgagattgttcttacactaatctgatcagcaactgcctccctttcagcgtcactgtatgcccggaaaacttttccctctattataactggttgagatgcctgggagtccgtgagtattccacactcaagtgctattgctctggccgtttgtaggttatctccagttaccattcgtacctgcttgttcaaaaaccgcaggagtttgtcaggtaatagtgatgagaagagctacaactattcaagtggcactgtgccaacattactagtgctcatagttttatgcctacacatccaacatgaacaaataaacagatttagttccttaagtaaaagaacatgaattctaaaggcaagaaaatcaagaaagtcacatatcttatgttcactggagcgtaattgtacatctaaatctgattttctataattgtatataacagtcaatatttgaaggaacattcaagtatcaacactcgctgtaaggaaaatgggactgtaatgtttgtaaaaatgcccattatgtcctccagtacacatgaattcaacaaactacatacctttacaccagcatttttgcacagatctacagcatttcttaccccagggcgacaggggtcctgcaaaaaatatggatgtcccaaacaaagacaaacaatgttaccagaacagtaataaaggaaaagtgagctataatatataactagccaaacacaaatgcaatcgcatggctagatactaatgcatgcttgtatttgaaaatagagttgtatttactagatcactcatgcatattgcaaagaatacatttttttatgaccataaggccctaataaccatccgataaatttatactgtaatctagacccaccatattaaattttgtataaccttttctttttcctctgattaacaagttaatttcttgcctttacaccagtgttttttaaaaaaggtttacaaggctgcatacaaggaacatttgtcccaaccttgtacatcttaaactgcatgagtggtcaattataccatataagtgaccgattatgccacataagcactacaaggtggggtgaccacacgaaaccgcttactgcttttcaacacattgttttagacatgtagaaacttcttttaacattgctttaaatataacagatatcataattcagatatcatggtttgctttgcatgtaccttcatccctacgattccaatgagagccagttcattatctggtaattcccagttgattctttcttcctcatttggaacataattcagatcaagatttctataagcaaaagcaacacatcgaagactttcctcggccatctcctctatgtatttcttgaactgattagcctgaaagacccagctgagacatgagaattattaaataaacctgagaagggtttcctatgtggttaataccttatcaggtgtcatttcatgactaatgccatttacatcaagccaatttgtacataaggcaagaacaatttcagcagcccctttccagtgcacatgaatatctgaatcatcctgaatgcaaacaatattataaggttgcagcgtgttacatgccaaatagaaggcacttgcaaatcatgaaaatatttgtactctagctaaactagatccataaaccaagcatagtgtttttcagattactgagtaatcagagcatgctcaacctgccatgcagtatttctatgtaaagaatggttttctcatttcagtgcaagaccttttgttcaaacaaatcaacaagaatgtctgttaacaaataggagaacttctgatacataagatcctttttgttacattctaaaatcacgaaaaaaaatgttctgaaccgatattatatcatattatcatagacattagacaagtaaaagaagatgtttggaaaaaaactaaactgcaatagtggagatgcaatgaatatacataacattaaattgaaaaagaaatgaaccttttgccaatcaaccaacaaaaataaagcatgtaatcatcaaattctagggagccatatttgagataaggcccattgccatttcatcgctatcgaagtacatgtacatattgacgacacaggaagaagctcgtgtatctaatgagtatgtgtctatgaaatcatttcaagaaataggatgccacgaacaaactaacagccaaaaactagatctcaaataacattagtgacaaaagatggatttaccacaatcactgcaacaccggcacgtttcttttctgagttgaatggggagacatgaataatagaagattttgatttctcctccgcaaatttcatatgaagctacaggaggcatcagccagataagtaaaaatgtagccaccaaaagagaagcaaagtatgagaatgcaaggaaacttacctcaacaccccaagaaagaatagccttttcagttggtgagcctgttatctcaataggactaccatcctgatgaatcaagaatcaggataacatagaaggataaaggtaccaatatgagacaatgcatgtaaagaatgcagatcactgaaaccactagcaatggcaccagtacacaagtacgaaaaaagacatatgtctcacattagagatcaaatttaaaacgcttcccctgcatgccttttaaaatggtatcaacttggtaataaactgactagtgctcatgtgcttcctcatttgcacaaatcttgaagcaggcaagcagcatccttagtagtggaactgtgtgttgttgcaaacagacactcaatatgatttaaagttcacactatacactattgtggagagcatagaagaacctcttcaagagaatgcaactcataaaaaaatcagaccaggatgttaaatacctaccaaatagataactagaatctaccaaatctaccagctactgaatagcctaatttagaataatgaacaatgttcaggtatgtaaactgcagtagtaataaacacgtggcatcacctctggctcaaaaacgctgcctgaagaattctgtgcgattccttcaagtataagagaggaaacaacaggcgacaaattctcaatatcagctggagatttcagctttatccccccaacaacagatcggacaacggtcatcttaagcaaccaaaattcagagtcaaataatcacaaaggtaccatggtaatttacaactgagtattagagtaaattgtatatccattactatgcaaaaacaactaacctgattgagtgttagtgtaccagtcttgtcactacaaatggttgtagctgaacccattgtttcacaagctgaaagcctccgcacctgaaaatcacatgagtggaaccatgtaataaccaaaagggtacaacataaacaaaaccgagaaatatataccagagctttgtctgccatcattttttgcatcgaataggccagcctgataaaataaaacaagaggttgaatgattcaaataaagttaaacatgaatgaaaacatcaacctatatcaactcacgttagagttacggcaagtggtagtccctcaggtacagcaacgacaacaatagtcacctacatggtactttgtaatataagaatgggataacagaagggtcttcagatacactgaacactaaaccactacataccgcgatagttagtatctttattgtcccaaaaattgtagatttcacacttgtttgccccttaacaaattgaatagagccatctggatttgtagtatgccctgtaaaatatctgggagcaaaggagaagttctaagtacatagtggatacatgggcaacaaacatcatatattacatatatacacaatcatgatggcgattcctaattatagtatcttatatatttctcaatatagggatcatatacatcattgtgcgtgtgtgcatgtattgtggtggggatcatacatcatggtgggggttggtcggggatggggggaggatgcaaagagactaaaccttgttacaagtgcagtagtgtctcttttcatctgtttcatgtatagtccagtttatatttaagttattcagatgataatcattgcagagtgagcactttattgctttaccaagcagtgtaatgatatgccatattgcactccaggttccagtacaattcaaaacgcataagtttagtggtaaaaagtgtcatgccgacaatttgatttttgcttgtatgggttaatcaccaaagctatactaaatttacatcaagaagatgcatagatagccattcactttgcttaccttgcaacaaggactatgagaaccattgcagcaacagaaagccccacaatacctatgaaagttgccactccattcaaccgtaccttcaacagaaaagagaagaacatgaatgaatcataagatgtaaatgatggcatgggcaactgttcaaatgcagggcaagtttggttctctaccctatcatgttttggttatttggtagtgccaaatcttgggcaagttttgaccctaccaaattttcgataggatagaggtgcctcaactatatggatttgacaaatattggcttcaatgcgaacacataataggtacatattgaagttgccaaattgttggtagtgcaaaaccaaaccagcccacaattcccattcaggtcatagcacagggattggagaaaaacctgtagtggagtttcttcattgttgtcttctgagatgctggccatcaataagccccactcagtgtttagaccgactgcagttacctacaaaagaaactgcaaaatttcatatacaaaagacttccacaccacattacaaatgttagaaaaaaaacgtcacaaacttaattcttgagggtataaggcactaacatacatgagacaaagtaatgacgttgatatttttgcacttcagtcgtgtaagtaggggtgaaatttcatatcatttcactagggtctgttaaaaagtccaccgaattggtttactctagcttgtgaattaatttactggactaaacagcagtacttaaatcgatgatcagaggtgacagatgggcctcaaattgcctctttttgttaacaggcatgcaattttcataagaaaaaaagtggaagagtgaggccattgaatcaagatatggttacttaccaacatggtaccataaccatcagctactttgcatcctcccattaagaaaggtgatttatggtccttgacaacctaataaaagaaacagggtttacatatgatggggaagtcagtcctatataggacaataggggtcgaaaaggttgcttacgatcttgctttccccagtcatactggattcatcaatggcaagagaatgaccactaaccaaaacaccatcagccgggacctaaaaggtgtatttagtttcattataatctcagaaatacaaacagcatagaacataaatcaaatcagaatgcatggatttacataatcttacctggtcaccaatttttagagccactacatcaccaactacaatatcaaatattgacacttcaatccttctaccacctctaataacctgacaagtgtaacacaaatacaaccccattagaggactaaaatattgttgctaattatctgagaaatgggtatattcatatggcgcacctccacttgtatattttgcttctcttcattaaggtgctggaactgaagggactgtttgtagtcactcacagctaatacaaaacaaaatgagtgtttagtaaagcaactaaattattccaactagagtgtcttgcatgggtttgctaagcagaaggaaaaaaatgttgaacattgaaaaatgaaggatatgggggaaaaacaaaacatgctgcagaaacattagtaaatgacaaacaacgtggaaactaaaaactgagcatgctttgagaacaatttgattagatctgttgagaaaattgcatacagtgtgttcttaatgaaatatcggacagcaaaagaatgttgtgaagcaagctattgtggctagagctgagactcttcaagcataggcgttggaatagcgtgcaggcttcagttaacagaatcaggataggcgagttgggaacatcagagggtcgtctgatactgatatatggaagcggctcaaccaaacaagcaataggtaataatgtcgtgtagcagattcgcgaacaagggttactgagcctgttgccctgttgtcagagaaagcacctgcactctctagctgacatatggaagtggctcaaccaaacaagcaataggtaatgatttgtgaagaagggttactgggcctgttgtcagggaaagcatctacactctctagctgccttttcgttgtattgtgcataatgtaactaagggtgcctgagatatttagacttggattgtttgaatcttcataacaagttctgtacaagccttatgtgtaataatttatttggggacgtctatcataactccattattgcagtaattgagtattatttgttactgttcaaaaaaagtacatgacaaaaatagaagtggtgttctatttaaaagagctaatgataaactgcaatcactttgccaaagaataacacaaaaaacatctagtcttttatcattacaaattaaagcatgactcaaacttcagaaaaagttaaagaacctttaacaatggtttgcatctaagtaaagtataatgatggtgtattcacctattaatatctcaactattgaactgcttagagaagatcaattagcatagagatgaacaggcgaagaatagcataccagtaacaagtatgacaagaaagaccgcaaatgcaatgcttgcaccgtcgtaccatccttctttgatgccctaatgaatttttttaagacagaacttagaactaaagaaaacactgatcaaaagttttgctggcagtgagggtgctcaactaaaccatcgtttgtggacattaatgaaattggatttcaagatcagaagggaaaataatatttaaccaatagttagataacatacagtgcataagaaatataagaaaggaggatggttataggagtcacctctgttgcaatgcccaataccagagaaattacagccgctatgataaggataactagtgtcaagtcttggcaagcttcccagaggaaaacctgttaacccccggaccccaaagaaagaaagacagacagacagacagacagacagacagacagacagacagatagagagatagatagatagatagatagatagagagagagagagagagagagagagatatcagtactgaaactaagacacgcttactagttgaaatggacaaataaatttaccaaaaaacttctcccctttttgcgagggtatctgttagccccaaaagcatttgccctgcatgccaaatctacctcatctccatggactcccttctccgtgtttgttttcagtaaatttgcgagtcctttaacctaatgtttattaaagaagaattccatgccttaattagtagttctaaaaatgatattcaagttaaatttgcagtatgaatggtacatgcccctccatatccgtgcagagaagaataatcatgatcccttgtcatagctgtaagctgctcctctccaattccgaacccgcgagggagaatttctgcattatatgaatgtgtaaggttttctctctttttctctttgcacagctatatatcacaatgcaattcagtcctttactatgtgaactattaatcctcgacaaagatagcaagcatattgataaacaacaaaggtaaacacaactaacaattattcaagagaaaaaaacacaactaacaattatgtctccagcctgaaagtgagtccacaaaagctacctggtaattccctatcaacatcatgcttttgtccagcttccttgaaaagtaatgcggcctgattgaattcaaaactgaaaccgtcaaacaagataccatgacatgatatgcatatcacaaatataaggttaaacatatacccggatgacttgagcatgagccctaattttcctccttatttgttccttttcctcctctttcttcagatcaagagtatatctgaatcgccgagaggcattgagcacaagagcagcttgctgccaatggaaaacatagttgtattgtgtaaaaataatgagcaggatacaacattagtcaagattgtatatgcattgctagttaaaataattttcacgagattgtttaacttgtaaattcagttctaacgattttacaagttcaataggatccacctaaaaaaatgatcaataggtcttcaaaacattaaaactaggacatttgttttcccatctgtgtacgaggttcattacaatgtctctgtacatgagggataggttcattacaatgtctcagcccgcaacagttgcatatgtagccaagggtcatgaatgagcctatacatgcatacctattcactaacatagtttaacatttcacagtacctgaagagaactaagaaccgaccattcatattcacagtcagtgttcatctcattagattctaggtggtagcaacagagcaaaatactaacaccagcaacattcggttcttacttcgtagtattgtttcctagagtaaaattggcaatcctcagatcattcggaagctttagagaaccacagttccacgattgagttttacaggagccacaaaataggaaaaaggtatacaggatcataataatagttcaatacttcctccgtttcataatgtaagtcattctatcattgcccacatgaatatagatgctaatgaatctagacattatatatgtctagatttattaatacctatatgaatgtggacaatattagaatgacttatgttacgaaacggagggagtataactaaaaacttaaaagcgcaagtggcagccaaaggtaaatcccgcacggaattaaacagcattgcacatggaagcatgagcagtagaatgtagcagttagcggagagaaggggaggaactcatactcaccctccaccggcgaagccgctcgacggaggcgcgcttggcggggatgtcgaaggggtcggccccctcgtccagcacgtcgacgccgagcacgtcgctgcagtcgttgccgttgccatcgtcgtcgtcccgccgccgatggtacctccccggcgacgcctcgggcgcctgcactcccaccggcatgattcctcaggagagatgacacggacaccaccaggcggcggccgcccccgatctgcacgcacattcccacaccaccctcatcagcaacagcataaacacacgcacaaaaaaaaaaaacaagcacaaatcccaacccatcccccgacccctcgccccccaaaaccaacagcgacacgcgcaaaaatccagagcaacctggggggcggcgagctgtagccggagccggaggcggcggcggcggcggcggcggcggagtcggagtggggggagggggtgggggaggaggaggcgtgcggcggaggaaacgaagcgaatcgagggctcagggctctgctctgctctgctctttaatttccgcgttgcttccctcccccgcttttcccgcttgaagagggggagtgcttcacgcagacgacgcggaggcgggggcgcttcggcttccgcttttttttgctttaactcggagaggaatcgcgccgcagttcgccgggggattttccggcgggtctcggagccgggagagtgtagtcgtggtggtggtgggctagtggtgaactcgtcgtcgacgtcgcggccgagtcgagttcgagaccgtgacttgtgtgatgaatggtgtcgcggtcggacgacgcgggggtgacctgacctgacctaacgagcccaactgctcgatcgaaccggcgcgattggctcggtgtctccgtcacgcgtacgtgctgggtgcgtggcacgcgcgacggtcttggctgggctgggctaaataaattgcgcgttggcgactttgtatctggggcgcacggcgtcgtgcgggcacgcgttggttcggttgcgaaccaacggtggaacggagcgacgaccctgtcggctgtagctggtttttgttttcaagtccgattgttttcctgatcctctcgatcggccagagccaggccaactagccaaaagacaagctaccaaaaatgtgctgtggctgggactgtgggtgttttccgtttctttttttttttactttgtctttttgtctctatcatatttacattctagttctataagaataggggggcggaaatttcttgaaaacctgtcaactaaagcgttgtgtcgggtttttcttttttttttttactaaatctcaatgctaaattgttgactagttagtttggtttgtaggcgaaggatattgaaacccggaaaataccgtacttaattgtaattccaccttagcctcactaattcatgtccagacctatacattaagttcacaaggcacgtcacatcccacaccagccacaagccatcaattttagaagcatcatcgtcgtctagttagtcactgtaatctcctgagttgtgactctcgttagtaaggctcctaccattcgaccattgcatcaatcggtaatccacattcgatctgtttattacaaaagccaaaaaaaccgatccgaaacattcatttttttcttctaacaaatttggttggcatatgttcaaacctaaagatctgccaaaccaaatgaatcaaatgtctccttcccctacttcccccactttatcctcttcatctccgagcattccccacttcacatcattagctgttgttttttatgtttatggtggccccaaagagattgagtacgataatatttcaagtaagggagagaggatgcaacagtaggggagattagtgatattgggtatgtatatggatgaagcgatgccaaagtataaaaataaatggatatggcgcaacaagttaagaggtgcgttaagaaaatattgcagaagaaaccatcacatataagaatttttttttctcaaaaaaaggggtgggttgtagggaatttaaaggattctgtatgtggaggaggctggtggctatacaaactctatccctccccgaaaaaaatactactctattagaaagagcttagaactctaaaaaaaaaagaaacatgggcatggtaagatttggtcattcaaattcataagataataatatagctatatttaataatttcaagtaaaattatatatatatagattatatattatatggatgctagccgcacaattacgcataagaaaaggaattcatgtaagcgtcgaaggcacgtacgattcctctccgcgaaaggagctcacgcgatcgggcgcatgtgcaaatggacgagagaaacgcatatacgtacgtacctcgggtaggtgatcgatccgccgtgcgcgcgccccgagacgacgacggcgagcggcgtacagagtgaaaaccagctcacaaccccaaacaatcaagcacgattcgatcgccggtcggctgagagcttcctagctcgctcgctcgatccgccggtcctctcgccgcgcgccgctgctaagctagcttctccgatccttgctactctcgatcgatcgatctcttgccgctcaactaggccaccagctaccgttttttcacgccgccctctttaatttggctacatatatgagatgatctctacggctacacgctctgctagctccatccgtccaaattaaaggggcttactggagagagtggagacacaaaacgcttgcttccggcggtgaacaaggaagcgatcgagcgcctctctgctttataagtatgtcggtagctagcttttgcgcatttgcatcgctgcctgcctgctctcaccttgtgctatcgctctgctcttttagagcaagtttaacaatatagccaactgctagctccaaatcagctatatccaaatcatctatagccaatgtaatagctaattcatacaatagttacttactatactattaatacctggtcctacctgacatacgcacattatgtcttggagtccgtgctgcagctgactacagatctatagcccactgttcttctttctcttcctttttctccttaaaatatgtttatagctggcttatagtctgctattgtacctgctcttatagagagagaagaaaagaacggtgttaactgttaagtatacggttttttgcgctacatatccgttatggtttttaatttgtgcagtgcaagttttctaagtctagagctcgagtagggctcaactagttaataacggcgtgattatattcacttcacgtattgatatatatgaattgaatgaatactattaccttcttacacaaatatacgacgttgattagtttaattttgagctaaccaacataaaaaaaatatggagggagtactacacactggggtgtaaatacacgagagggagagagggagagagggggagttgtagacgggatcttaattagtagtaatagaatgtactaaagagtcacgtacgaccaacgaaagaatctctcctaacagcagcaacatcagatactgacatatactgactagctaggatcttggaggagatggatatctatatcctcgtcccgacctgtatatatcgatgatttggcaggcagggtgtcgtagagctcgatcgatctgctgttcgcatgcttttgcaactggatatatgctaattaatcccactgttcatatgcagtagcttaattgactaggtcgttagtactcatgctaattaatccgacttttcatatgcagtactactactaattacttactccgtcccataatataagggattttaagtttttgcttataacgtttgaccattcgtcttattcaaattttttaaattattatttattttatttgtgactaactttattatctacagtattttaagcacaatttttcgttttttatatttgcaaaaaaaaattgttggaaacttggaacacaattggatgtcatgcatgtgtgtacgccgtgtcgccgtcctttgctactttttactcgttgatctagttgctcgatcgagcataattgcaactagatccatcacaatgtcgtcgctaaatcattcattcacacggattaattaagatatcgatgcatgcacgggcacgatattaatgttcgaaattaagtttgatatgtatacagatcagtaaaagagtagaatgacgcagctaagctagagcggttacgttcatcatcggttgggcggcagattattgcaaccatgcatataagcttgcctaagcagatcgatcacaaattaaagatatactatcacttttgtctgatgtcgtagacgaaccttgcgacaaatgtaacgacctagcttttctgccgtcgtgacgatcaatccacccctttgagcactcaaagcatatttgagagtatatctatgtacacattttgtcttatgcaatactacatgtctacatatacaaaatttgtcttatgaagcacaggatcactgcaatatatagtactccctccgtttcgaaatgtttaacactattgactttttagcacatgtttgaccgttcgttttattcaaaaacttttgtgaaatatataaaattatatgcctacatgaaaatatacttaacaatgaatcaaatgataggaaaagaattaatagttacctaattttttttaataagacgaacgggaacatatgcttaaaaaaatgaacggcatcgacatttcgaacggagggagtatattaattcgctattttcgccagaaatttccgcgctgcttcattcgctatgtatgcctatgtttttgcaaaggtattgatcgatgacttgaccaaagtagaacatgcatgagtggcccagggatagataggtcgtcagggcagaggatcgcatttgtgcggctagctaaccgacctgacctggcgtccatgatctcggtctccgagacgacccggagcaatttcaggcaagtttccttcgaatggaacatgaactactcactctttggtgagtacggctgtatctagctccttcaaactttaaaaaattccatcacatcaaatatttatttggacacatgtatggagcattaaatatagacgaaaaaaataattacatagattgtatgtaaattgcgaggcgaatcttttgagcctaattacgccataatttaacaatgtggtgctacagtaaacatttggtaatgacgaattaattaggcttaataaattcgtctcgcactttacatgcggaatctataatttgttttgttattaatctatgtttagttcttcaaatgtgtgtccgtatacgttaaaaaaaatttggaggaggaactaaacacggcctacattttccaagctgaaacatatgtctcagcgtaaaaattttctatatagaagtttaaaaatattaagtgaatttattttttaagtttataataattaagtttggaaagcactcgtgcgtgcgctcaccttaagtaaagaaatagcacttcctgttatgcagaaatgaatgtagcctaagacattcatgttgcaacacactcttagtcttagtcttaggccttattcaattaatcccctttagaaagggattagaggggatttattccacatggtgtgaaatcattctctctcaatcccttccaatcctcttcaaccccatccaaatcgaacaaggccttaggagtgatttaaaagagagagagcaccacgtgaactaagactataccccctaatattgtagtgcaaaatgacttaagtgtggctttaattttacaagtccgtccctaatattttaaattttcgttcacatattctttcaattgacatataaactcaaattttaccctaaacgccaataaggaaactaaaactattataaaatcaccccttcccccaatctataccatattgttcatccctctccctctctcctctctcacggcaccttcttcttgtgaggaccagacacgactacacgaggacgcacaacaagatagtggtacgggggttgcagtgcaccacaactagtcacccatgccctctgcaaggcacaagtgccatcacgggggacaatctcggccttgctggcgtacgcgaactgatgtggaagtccgaggttgctttgcaccttggtgcattgtgtatggcctaaggtaatttatcttgtacatgtaaagttatagctattatcaagttcataaaaaatatgttatatatgtacagacacgttggtaaaaaaaacaatggtgagaggtgctctaataaggcatatatgaagctagcgaagtgtggggtggagataataatgacatatatgggattatgtttgttttgttatctgtctatattgtatattgatctctgtcagggttatgaataccacatacttaatagtagtcgactaaatctcggcaggacccacttacataccatgtcttatacggaaacaaacttcgaatacaggaggagttccgcataaggaagaatgattagagttctacgtggaaacgacaaggactacttggattatatccatattggtttctctagttctatttagacaaggagacatctatgggtataaatacaaggccccctaggaggagaggggacatggaacaatagaccaagacacaagatcaacaacaagccaacatacgccaagacacgccgccggatatcaacttcaaagataagcatggctagtcccctactatgtctatagatactgtcaggagagacatagcgctgtctttgatctcgctggacacggatttgaggaggaaggctaccctgttgtcgactacgtgatgatacttcaagccaccatgtcgacaaatgttagataggctaccccaaatattgtattggtgtgattatggtgaataagagtaacgactggcttcggtcaacaggagtagggttattacctgacaattcaggagcccgaacatgtataaaaattcccatctccatctcttttacctcaatctcgcatataccatggtatcaacgatccccatactatgtaaataccggaatcgtgacatcaaacgtcgacaatctccctcatagtatttattatttaggagaaagaatgtatcgaacttttacaactcttaaaacaattgattttgtaatagagtaatgaaatctgtaactttacgatagtactttttagcaactataataatagtactttttgagcaaaatatactgatagcattttattaaaactaagcacttgaattattaatgattggaattcttcaagtttaaccaaatatcatattaaatattaaatatttataactgagcgcttaaactatttgtttcaatgctcaatttttacatttattgtaacaagctagaacgaaagcgcccgaaggcgatagctcaaaaaaaaaaaagagtatttccaggttcaagcagccatcctcctgcacgcagtgccagtgcacatgctctcatttcgtgcgtgtgctatccaaagttccaaactattatcaacatttttctttaaaaaatggtctacatattcatgttcaaaccatcatcaactaacgtgaacacacgtactcttatttagttatttgtgcatggcatccaaactgtcatttttctaaaaaaaagttatattattttttcacttttataaatatgcaagatgtttattttgttttggttctcttatgtttctccgtataaactgaattaagtattttattttgtgaagtgatatagataagatcgatcttaacctgtactacattgttaaaacactttacaatttttttggatatctaggtgacaaaggatatacactgccggaacggtcgagattctcggtaccatcacgcgttttgtggccgaaagcggccgactttgataagcctttaggggaagatcgaacgaacgtagaacatggccgtgtttagttgttttggtaaaaaaaaattttatatatacacattacaaatgtattaaatatagattaataataaaataaattacatatttcgcctgtaaactgcgagacgaatctattaagtctaattaatccgtcattagcaattgtttactgtagcatcacattgtcaaatcatagtgtaattaggctcaaaaaattcatctcgcaatttacatgcaaactgtgcaattggttttttatccacatttaatactctatgcatgtgtccaaatatttgatgtgacgaaaaagttaaaagtttgaagggaactaaacacaacccatgtgtgaggagtgagtttcgggtgagagggaccagtacatacaacctcttttccaaaataatatatatttccgttaacttttcgtataatgttttatcatttattttatttaaaaatttaatatagatatgtaaaaacataagttaaaattataatttattttatttgtgataaaacaagtcacaacaaaataaatgatatttacaatttttttagtaagacgaatgattaaacattatgcgagacgtcgtacattttgaaatgggcggagtagtatatacctttgatggtagattaagcctgcttgtttgtgcaatttttgggaagcggattataagccgaaggcaattttaaagtcttcaagacttcagcttcttggctgaggatatcatccgcatgtttaaagagaccaatcagtagcttgattaaggctatcgtaaacttaaaaagtaaatttatttaattttaaaaagttttacatagaaaatatttttaaaaaataaaagcgtgctaaaaaaactaggagctagataggcagctggtaagtagaatcaaacagtgccttagcagtcatacaatcagttggtttcccttgagtgtaggttaattaagggtgtatttatgaaggtgtgagtacgttattacgtgcatgtgtagtgttgtatgtacgtgtctaccatgtcatcggaaaaaagctaactcataaaaagagatgattaaaagccataaattaatcttaaaattaagtcatagttaaaattcaaaattatcgtcacttgtaaacttaagctcaaacaaaaatacccttgattacattcttgtaaaaaaaagaagaagaaaagctaagttacctgcgacatgacgtacggatgaacgttatatttaacaaatcttggggtgtgtttggaagcgagggttacgaagcagcagggttacgaagcagtttagtgcatgattaattaagtattaactaaaataaattaaaaaaatgaattaataagatttttagagtaacttttatataattttttttaaaaaatacaccgtttagtagtttgaaaagagtgcgtgtggaaaacaagagatgtggggtgagaaagtaaagataagaactcagcttttcagttccctacgggataagtttctcatgcactacttgacccccaacagctccactagcgcaagtgcttgcacttgtcatcgcaacaaaaaaaaaatcaacaaaacagctacggtacaaattatgttgcacttgtaaaagcgatcaattaataaaaactaatctcctaataagtacagatacacatataaaaatcgctttattataattaaagatagtatcttgtcttcttctctttgatatgtaagggcaaatggacaatcacaaatgaaaaaaacataacgcgaatattaggaagtaacctaatattaaataaatagaagaggctagacttcgaactcagccaactaagcccatcgtcaccttgttgagcagtcaggaatccctggcatttctcgggcaatcacaaatgagctctcgatcgatctccttttctatctgtctgcttctgcaagcaactcgatcgatctatatatctagccagattattcctagcttgagtgtttcgcaactgcatatgctaggtccccggccgatagatcgatagaaagcctcctgcatgcaggccagttggtcgcatgcgtaatagctttaggacctgttccttcctgttctataattcttagcgttttagataaaattaaggctaaactattataaattatctagcttaaaaggcaaaatataaatatatagatttatctcacaaagtatactatgataaaattaaaattgtatttatttattgtatatattttgtaataaaaagctatagttatagatatattttagagatggtgtcattattcaaaacgttaaaaattacgaacggaggtagtaggagtacttgggtacttttgacaactatagctacttaaaaatcgctagctcctttaaaagatataaattttgtttcgatttggacacttagtaactacttcatatgtcccaaaatataagtaattttagagggatgtgaggcatcataatactacaaggccgagtttagtttcaaactttcaacttttccatcacatcaaaactttcctacacacacaaactttcaacttttccgtcacatcgttccaatttcaaccaaactttcaattttggcatcgttccaatttcaaccaaactttcaattttggcataaactaaacacaccccaaatttaaataacatatatatttctccaaaatcctttatattataggacagttggagtacataagagaaaaataaattagtagccatcgactcagcttatagattctgattaactggatacttaagtacttaactgcttctcagaacatacatttaggtctcaaataggtttaagtcgggtaatccacctggctcagaaatgcagctcatctgcctcgatcaagcgatcaagcgaactactagctagcctagcagtagctgcaggttagattgggagttaggttgcgttaactaatataatcgcgcattaattcgatttgatcatccatgatgcattacatccgaccacacctgacgtacgacattactgatcaccaactacaacagttgccatctagtgaaaagtaacaatggtagatcaagattatgtcatataatacacatgtttaatatataattatcctatcatgacagtgtttacttagacgagtttgcaagtgctatttacacctgctcccggtgtttgcacacacattgtcattattagcagatcggcgtcaggtcctgcaggctgcattatcctgctagcactttagacccccccccccccccccggttttgagatataagcatttttagattatttagcagagattaaaatcagaaagaaaatattttgatacatctcattaaataagagatggttatggtacaagcatttctaacatgtttagcagatgttaaaatcacaagaaaaatattttcatacaattaaacaacatatggttatgagtaagatggagaaaaaataaacagaagttggttgatgagatgagtagtagtaataagaatatgtagcacaagaaatgcttatatttgagtataaattttaaacgatagaactgcttatatttcgaaacagaggggttaaatcttatccagatgcacactattccagtttgggctatgctggggaagatgaaagctgcgtttgcatcattcacgcggagctcgctttattcctctttggcaaaggtaaggtaataacgcgccagggcaagctggccatctttttttagattaaaacaaaaggcaaaagagatgaaatgaagaatcatcgaaggtaaagagatggaccatcaatgatgagaggggttacacaattgtactccattcgtccaaataaaaaacccaacctagtaattatttagattcatcgtaatagattatatcccatccttaattaggttggggttttttttggactgagggagtacatatttgcaatgtttttgaaaatcaaaagcccatttaaccaaaggaaagatcaggcttagctgtgtcgacggcccagcagccagcactagattgagcccagtgagagatgcagaaaatatttcgaggtcgaactcaacttagtggacaatgactaaaagtaatttgacttcttttttaatctaggaaatatacagataagactgttcacttacaggttattcagatagcgatgggagcaacaggccaggcattcttgatgccttctgaatctgcagtgagtttctaccaaaaataccaggttgtgacttgtaaattaccaatggaaaggagagagattagtttgagcagactgcatatttcaaaatcttgaaaaaaaaatcaagctttcaagctctcgatttcctgtctctccactttataacaacttgaatttgcacgtcagaattaagagcagctcttgatgagagctaaatgatcttctggtgatttagcctcttaggtagtagtgtaaaacaacgaaaatcatcattctgtacatttctttcccacagtgtcaaattggactttttgtaatacagtaaaccatccagtacaggattacatatctatattgaacctgaaattctccatcttttctataaaaacacgatggtgactttgactcctccaggaaaaccacagcatatgcttttgattttggaatggagcagacagacattcagataaatttattgaagagtactaccaactgtgactgtttggtgagtcttcctgcagcaaaacttgatgtttcagtgtaagtagcaaacagtattacttatgcacttatttcttttacacatataaaaaaaaagatctaagggaagtccataatacttgcgcgaaaatgacggaatgcaatccctgagaaattcagatgtcctgtatccgatgaattatttcaggatcccattgtccgctgctgtaactggatggaacaacagatatctcttgccttccttgccactcttcaccaggccttaatgtaattggcttctcagcatttgcagcccctacacatagcatgcatttgtactcttcctccccaaaatccagtatcgtttttgctttcctgtcccatgggttccaaacaactgcataaaaaaaagtatactgacgagacatatatatacagaaggccccttgtgggtggcttctttgttgacccggcaaatacacacacacacacacacacacacataaaagtaagcaaaacaaaaggaccagaacaaccgtgctgtgtaatccagaaattagcatcttaccaacatcaggaagtccctctttccttaactcaaaagttctcttcttgtcatggtcaatgatcacaatcttgggtggagcactcaaatataccttctccgccttagcaatcaaagcattaacaagaaacacaatcttactgcaatggctgcaaaatatgaaacttgcaaatgaattatgaagcttacttcagattcgaatacaacggcatctccttgttcagtacaacgttttccacattgcaggttgtcaatgtagtccaaggtctccaaaccctcaacccgtacttcactggaatgtgaaaacaatttttatggaggaaaaatacaatgtagaagccaagtacccatatagtacatcattcattctgtacatttgaataatatttggagtgataaaatccaaaagaggtccgaacataacttttgtcaacaaaaatcagcacgacttagtatagaagtgcatatcctatgagctatatgcctcagtcaaagaatgtaagaaatgcctaattttacatataaacataatacaagcaaattaccacgacaaaatgtacctgatgtcagagactgaaaaatatgtgttatatgaaaatccaaatttgaatggcttcccatctgcattggtattttttattcgagatgtgagcatcagatctcctgtagggctaagagcaactcgcagcctaaactcaaaactgaaatatatggataatcaacttcatcaatttagcaggagccaaaggatatatcaattcaaaaatggaacattctaatctaccaatgccatagcaaataatgttaaggatttactagaggacacctatgcggccagatcttcaaatcttctggggactgcttgagtatcaagtcaatatgacagtttgaagtggtagctggaaaaggagggggagtttcatcaacactccataatcggttccttgcaaatccatgttgttcaagaactccatggttcccaaactgcatgatggatcgtccattttgggtattacaggggagacaaaattcttgaaaaacataactggactatgaatgaacagtcccagggtcatacttgaggaaagcaaatttgtatgcccccacgaatagcctttggtggtttgaaataagcctgccaagaaatttaaaaaatgtggaattattgggtaattgtaaatggcttaagtgtcaattcatgtaattggaagataaaacgtttgacactcataacatatctcattttcctgaaaaactaaaaacgaccaaaaaaaagaatggtaaaacaaccacttatctaagaaaaggaagccttgctgccaaatctgtagagtgcataaatgtaaaaatgcattcgatatataggcctgcaaggcagaaataatgcccttactgaacattaaaagatctgaatacctttctactaacaaagagcagttgttctcgatattcattttcccaaaagatcacttggcctccgtacagaaatacctgaaaatagtgaaaaataacgtacttgaccatttctgaggaaaaaaaaagataataaggaacctgtaaggttatctaatataactgaaacaacaacaacaacaacaacaaaaaggtcataaaaaaacaaagcatgagcaatgtgcaaacatgtccaagtgatttttgtttgaacgaaaggcaacttgccttattcattagagcaatatttacaacaaacatgtccaaatgattgggtctaaaacagatgagacataccgttgccgagaatacttaaaataatggcaaaaggccaatcaaaaccacagctaacaatagcatcatggtgtccacccccaataaacaatttatccacatcttaaagaatgaaatcaaatgatactaaattaagcgtagatatgaacatccacctccacagacaagccaaaggtcaaacaccaattgggcatttgaccaaacctgctaccttccctcgcatgatcgcaacaaactaaactacagtaatactcaaacattttctccaccaccagaatcaactccattaattcccaccaattccccctaactaattacatctcaattacaataattttgtggaggattggcgacgaacagatcgatccagtgctagaaatactgcaactgaaagctagggttgaggagagggggtcgacctggacggagcagccatgggcctcgcgcaggacgagcttctccagcccagtggcgccgtccttcacgacctccacggacgacaccccgccggccatcgatcctagccgccgccgccgccgccggggaggaaacggaaaccggcggtgaactccggtgggggaaaaattggagggaattgaggagaaacgatgggatttgtcgctcaaatttataggcgctggcgaaacaaagagggaaaaaaaattgttccagagtttgaattgtttcacgtcaatttcatatataataaaattttcaaaaaaaaaaaatctgttgaagtactgattcaaggtttgccgcagctaacccatacgtacataaagaaaattataatatttttttgaaagcagcaaagtgcttgcacgtatgtagattgattccagggtattatttaggttattttttggctggaaaattaagaagaagaagaatatttctatgtgctgctgttgatcagaacaggtcatgcgttttcattatgttggtctaattttctgaccagctgtgagccattgtagacttttgtatttatttttttgcagcaaaggaaaacagaaacttcaaacctaaaagaatagccaacttgaaaaggctttactatcctacctgagttacaccctgcagcagagacaaccgattcaattcaccaacaagagcatgtttttttttaaaaaaaaagaaaaaaaaactgtgttaagaaaaaagaagatgcgaaaacgaacgttactactactttcaacggaaattgcgagaggcctgttgggctgtcttgaaaatgggccaagctgttggttttgggcctttcagttggctctgtcacataatggaaataaagcccaatagtctcaggttgtgttggagaattgaggggtttcgtctgttgacctaattgtgttggagaattgaggggtttcgactgttgacctaattattaatcaaagataaagtcaaaatttaaaattttaaacttaaatttgaagttaattttaagacaattttgacgcagtttttttatattggcttttaagtcgctaagaacacatatacaaaagttttacctatatattattttttattccctaataaacaacttatattagataatatgggcaaccgatgaggctgtgagagaagggggaaaagaagattgataagatacgtaaaaccaagtgagctattagtacataattagttgactatttattattttaaacttaaaaatatattaatataatttttaaagcaactttcctatagagaattttttgcaaccaacgtactgtcaaatagttcagaaggcgtgcgtgttgagaatgagatatcttttctcccaacccattgggagaaaaacacaacctcaatttactttagttcagaaggcatgcgtgttgagaatgagatatcttttctcccaacccattgggagaaaaacacaacctcaatttacttatagcattcaaaaacaaaatgctccatcatttgcttgttggtttatctgacgcaatcaaaatttgaattttaaaacttagtttcagagtttactttaaggtttttcatcgtaatttattttctagcattagcttttaaacttataggaacaaaaatataacagttttaattaactatgaattatttttatttatccattcatttttttcatggtttattagccataaagcaaataaggagagtcagaaaaaaattgctcatggagcaggctattccatgcaggttctgaagaagaactcttctgtctatcacctagctagaatgcagatgcatgcatccatttgctacagtattgacttctttttcatgtatagcagtagtaactgaaaccttcgatccaaacaagcaaacgaccatgcatgtgtaaaacaccctgacaccatatatatatatgtcacatcagcattgggccatatccatggtaccatgcctacacatgctacaatatatgtgtaactgttttcttttttcgatcagcaaaaagatgattgcctttgaaaagggctacagccactgttcatctagcaatatatttatatctacaagttgtggatcgatcgtcaatttcgactcgagtaaactctgaattaatctctgaacagttctgacgatgaacatatgcagcctatatacatagctaagcgattggctctatatacatagctggagtagtatagcttcccagctgctgcaattgattaaattgatttaattcgatctgccactgcaaatctgcaaaagggctatcaccactgtccgatcgaattcgtagtaatagattgtgtctaattgatcagtaattaagttgctatatttctaaacggaggaaattaatatttatatatctacaagtcaatcgatcgatatcaatcgccaatttggactcgagtaagctctgaattaatctctgaacagttctgacgatgaacatttgtatgcagcctagctcatataggccttgttagttccaaaaaaaaaaatttgcccaaacacgtcatatcaaatctttggacatatgcgtggagcattaaatattgataaaaaaattaattgcacagtttacatggaaatcgcgagacgaatcttttgaatctaattagttcataattagccataagtacatatgctaataacggattaattaggcttaataaattcgtctcgcggttttcaggcaagttataaaattagttttttcattcgtgtccgaaaactcctttcgacatccggtcaaacgtttgatcgatgtgacaccgaaaaattttcttttcgcgaactaaatacacccatagctctcccagctgctgcgatgatccagatgaattgattaaaattgattcaattctgcgcaactgcaaatctgcaaactgatgaatgcatatgatcaatatggaccggaataatgcgtgtgtggcagtagcagtgaagactgaagagagcagctttaaacaagatttgagctgcggctagctagcagatgaatcgtggtgtagatcgatcgacgacgatagctagctgaggagaactgcaagagaattgatttggcctctctatccagaagcaataccgttggtcaattaataattcagactcgagatatcaacgtacggcttttcacttttgccgcattacatttctgatgatttctccagtctcgattcgatcgatcgatgtcgggattcgtgcaaatttttgtacgggtgctgccttatttacttatgattgggcagagtaaaaccacattgtaataagttatttcctgctggcagactgccacagtgactgggatcaaccggacatatgtcgtgtggtgttaatctgtgccatgcgcataggaatatataactttttagaaaaaaacatttgctaaatttatggaaaatgtccgattttatgtgccattttatgcaaaactaggctttgaaataattacatggaaaaaatattatattttgtgtgtataaaataatattaatcatgtgccaacaccagctcttttgcctatgtgattgtgcaattaattccaggacatcagcagatattgaatactgggagttatatatgccatgtagcagtaagcttatagtaataactacttgtcttgcccatttgtgttttggcttataaaccataatcaattaattttaaattttagaacttgacttgtgagggtatttagaacttgattttagaattaattcggtatttttttttggtaggggggggggggagatatttaggggaatggattctaatccctcgaggggatatcccctcgtatacctttttcttccaaattcgatgcaaatagtagtgaaaaattctgaaaaaaattgataatgtggagtataatgatacctactactccaccaaaattcaagttcaaattcgacctacacatcgagaaacaaaaaaagataaatttagatataaacagtacgctactattcatacgctgaatttctcttttttatatctcgatgtgtgagttgagtttgaacttaagattttgtgtagttgtatatatgaatgttgtcaaatttttccagaattttttataaccgtttaaatggtttttaaggaaacgagggaatatcccctcgagggattagaataatttcccgatatttgggggtggtttttggatgactgaactaccaccacacaagcaccatatagggttttaactatcttgatttggaaccggcgagaggtactcaatactcaattttggagttgagaagtatatttggacacatacaatagtttgagttggtcgaatctcgaatagaatgatgcttatagacaatatgtatttaatttcttacccttttggtgagggttaccttctacccggttg
